(12) United States Patent
DiCosimo et al.

(10) Patent No.: US 8,759,044 B2
(45) Date of Patent: *Jun. 24, 2014

(54) IN SITU EXPRESSION OF LIPASE FOR ENZYMATIC PRODUCTION OF ALCOHOL ESTERS DURING FERMENTATION

(75) Inventors: Robert DiCosimo, Chadds Ford, PA (US); Arthur Leo Kruckeberg, Wilmington, DE (US); Thomas Edwin Van Aken, Kennett Square, PA (US)

(73) Assignee: Butamax Advanced Biofuels LLC, Wilmington, DE (US)

( * ) Notice: Subject to any disclaimer, the term of this patent is extended or adjusted under 35 U.S.C. 154(b) by 27 days.

This patent is subject to a terminal disclaimer.

(21) Appl. No.: 13/525,075

(22) Filed: Jun. 15, 2012

(65) Prior Publication Data

US 2013/0157324 A1   Jun. 20, 2013

Related U.S. Application Data

(63) Continuation-in-part of application No. 13/427,987, filed on Mar. 23, 2012.

(60) Provisional application No. 61/466,712, filed on Mar. 23, 2011, provisional application No. 61/498,292, filed on Jun. 17, 2011.

(51) Int. Cl.
*C12P 7/62* (2006.01)
*C12P 7/16* (2006.01)

(52) U.S. Cl.
USPC .......................................... 435/135; 435/160

(58) Field of Classification Search
None
See application file for complete search history.

(56) References Cited

U.S. PATENT DOCUMENTS

| 4,683,202 | A | 7/1987 | Mullis |
|---|---|---|---|
| 5,514,583 | A | 5/1996 | Picataggio et al. |
| 5,710,030 | A | 1/1998 | Anderson |
| 5,712,133 | A | 1/1998 | Picataggio et al. |
| 5,766,912 | A | 6/1998 | Boel et al. |
| 5,780,275 | A | 7/1998 | Oda et al. |
| 5,817,490 | A | 10/1998 | Hubbs et al. |
| 5,874,558 | A | 2/1999 | Boel et al. |
| 6,027,910 | A | 2/2000 | Klis et al. |
| 6,352,841 | B1 | 3/2002 | Lehmbeck et al. |
| 6,495,357 | B1 | 12/2002 | Borch et al. |
| 6,867,010 | B1 | 3/2005 | Pedersen et al. |
| 7,037,894 | B2 | 5/2006 | Marshall et al. |
| 7,132,273 | B1 | 11/2006 | Choi et al. |
| 7,157,263 | B2 | 1/2007 | Munk et al. |
| 7,192,764 | B2 | 3/2007 | Fukuda et al. |
| 7,223,575 | B2 | 5/2007 | Zhang et al. |
| 7,271,139 | B2 | 9/2007 | Tsutsumi et al. |
| 7,335,504 | B2 | 2/2008 | Haupts et al. |
| 7,371,423 | B2 | 5/2008 | Soe et al. |
| 7,384,787 | B2 | 6/2008 | Kazlauskas et al. |
| 7,445,912 | B2 | 11/2008 | Marshall et al. |
| 7,598,053 | B2 | 10/2009 | Gidekel et al. |
| 7,622,109 | B2 | 11/2009 | Gidekel et al. |
| 7,666,630 | B2 | 2/2010 | Yaver et al. |
| 7,736,643 | B2 | 6/2010 | Choi et al. |
| 7,741,119 | B2 | 6/2010 | Vitanen et al. |
| 7,851,188 | B2 | 12/2010 | Donaldson et al. |
| 7,888,064 | B2 | 2/2011 | Berger et al. |
| 7,897,396 | B2 | 3/2011 | Caimi et al. |
| 7,910,342 | B2 | 3/2011 | Liao et al. |
| 7,951,267 | B2 | 5/2011 | Borch et al. |
| 7,985,573 | B2 | 7/2011 | Yacoby et al. |
| 7,993,889 | B1 | 8/2011 | Donaldson et al. |
| 7,998,722 | B2 | 8/2011 | Vittanen et al. |
| 8,034,579 | B2 | 10/2011 | Lutz et al. |
| 8,129,162 | B2 | 3/2012 | Li et al. |
| 8,158,387 | B2 | 4/2012 | Lee et al. |
| 8,187,854 | B2 | 5/2012 | Vind et al. |
| 8,188,250 | B2 | 5/2012 | Bramucci et al. |
| 8,206,969 | B2 | 6/2012 | Hauer et al. |
| 8,206,970 | B2 | 6/2012 | Eliot et al. |
| 8,247,208 | B2 | 8/2012 | Caimi et al. |
| 8,283,149 | B2 | 10/2012 | Niu et al. |
| 8,323,935 | B2 | 12/2012 | Xue et al. |
| 8,354,254 | B2 | 1/2013 | Suzuki et al. |
| 8,409,834 | B2 | 4/2013 | Burlew et al. |
| 8,420,349 | B2 | 4/2013 | Kralovec et al. |
| 2002/0150594 | A1 | 10/2002 | Goldman et al. |
| 2003/0036092 | A1 | 2/2003 | Iverson et al. |
| 2003/0073109 | A1 | 4/2003 | Pan et al. |
| 2003/0190601 | A1 | 10/2003 | Sabbadini et al. |
| 2004/0063184 | A1 | 4/2004 | Grichko |
| 2004/0132971 | A1 | 7/2004 | Haaning et al. |

(Continued)

FOREIGN PATENT DOCUMENTS

| CN | 1986558 | 6/2007 |
|---|---|---|
| CN | 101285078 | 10/2008 |

(Continued)

OTHER PUBLICATIONS

Mariano, et al., "Bioproduction of butanol in bioreactors: new insights from simultaneous in situ butanol recovery to eliminate product toxicity," *Biotechnol. Bioeng.* 108: 1757-65 (2011).

Nielsen, et al., "In situ product recovery of n-butanol using polymeric resins," *Biotechnol. Bioeng.* 102: 811-21 (2009).

Srimhan, et al., "Selection of lipase producing yeasts for methanol-tolerant biocatalyst as whole cell application for palm-oil transesterification," *Enzyme Microb. Technol.* 48: 293-8 (2011).

Yoshida, et al., "Water activity dependence of performance of surface-displayed lipase in yeast cells: a unique water requirement for enzymatic synthetic reaction in organic media," *Enzyme Microb. Technol.* 48: 334-8 (2011).

International Search Report and Written Opinion of International Application PCT/US2012/000288, mailed on Sep. 25, 2012.

(Continued)

*Primary Examiner* — Nashaat Nashed
(74) *Attorney, Agent, or Firm* — Christine M. Lhulier

(57) ABSTRACT

Disclosed herein are methods of producing alcohol esters during a fermentation by providing alcohol-producing microorganisms which further comprise an engineered polynucleotide encoding a polypeptide having lipase activity.

24 Claims, 5 Drawing Sheets

(56) References Cited

U.S. PATENT DOCUMENTS

Figure 1:
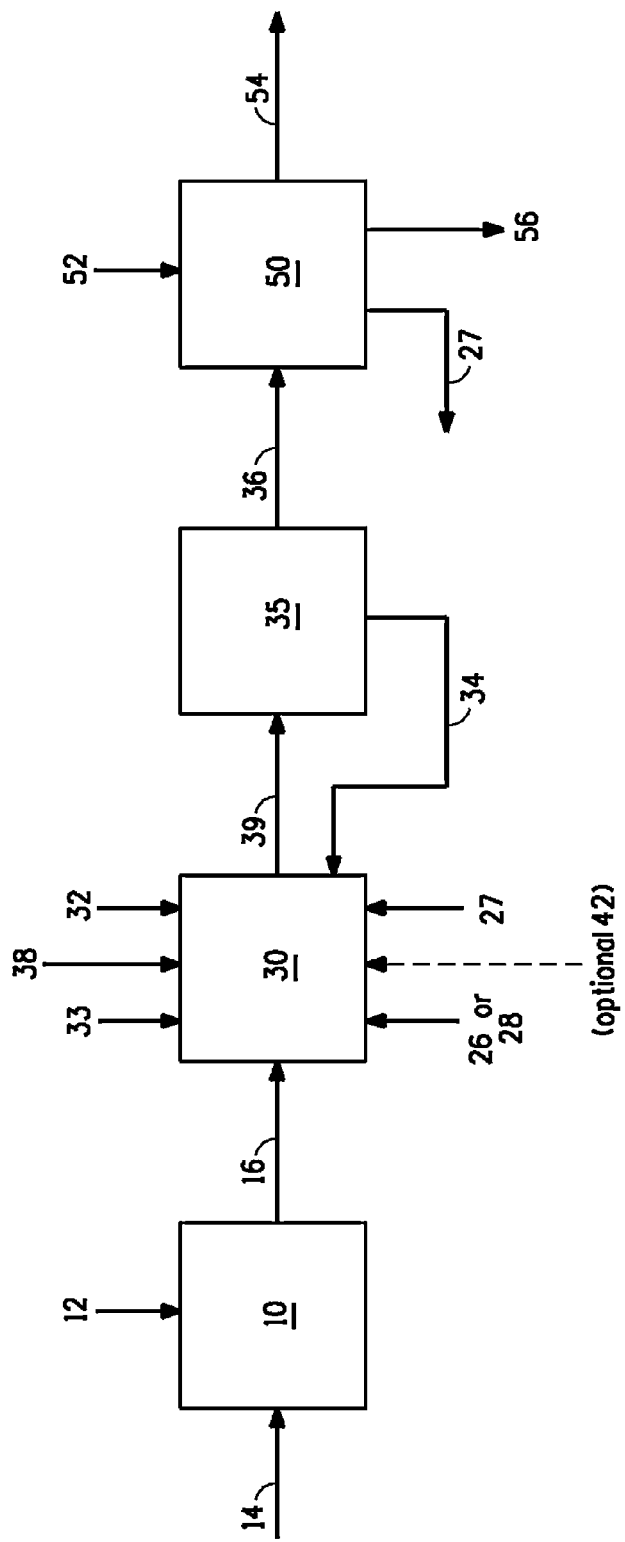

| | | |
|---|---|---|
| 2004/0180348 A1 | 9/2004 | Pan et al. |
| 2005/0084941 A1 | 4/2005 | Abe et al. |
| 2005/0175581 A1 | 8/2005 | Haupts et al. |
| 2005/0176096 A1 | 8/2005 | Kwon et al. |
| 2006/0246417 A1 | 11/2006 | Song et al. |
| 2007/0031918 A1 | 2/2007 | Dunson et al. |
| 2007/0092957 A1 | 4/2007 | Donaldson et al. |
| 2007/0134780 A1 | 6/2007 | Grichko et al. |
| 2007/0292927 A1 | 12/2007 | Donaldson et al. |
| 2008/0182308 A1 | 7/2008 | Donaldson et al. |
| 2008/0193991 A1 | 8/2008 | Allen et al. |
| 2009/0042263 A1 | 2/2009 | Kralovec et al. |
| 2009/0082221 A1 | 3/2009 | Wang et al. |
| 2009/0155870 A1 | 6/2009 | Donaldson et al. |
| 2009/0253171 A1 | 10/2009 | Yaver et al. |
| 2009/0298706 A1 | 12/2009 | Lee et al. |
| 2009/0305363 A1* | 12/2009 | Anthony et al. ............ 435/115 |
| 2009/0305370 A1 | 12/2009 | Grady et al. |
| 2009/0317866 A1 | 12/2009 | Cherry et al. |
| 2009/0325240 A1 | 12/2009 | Daniell et al. |
| 2010/0047836 A1 | 2/2010 | De Maria et al. |
| 2010/0071259 A1 | 3/2010 | Hu et al. |
| 2010/0081154 A1 | 4/2010 | Flint et al. |
| 2010/0151502 A1 | 6/2010 | Hauer et al. |
| 2010/0180491 A1 | 7/2010 | Lee et al. |
| 2010/0197519 A1 | 8/2010 | Li et al. |
| 2010/0199548 A1 | 8/2010 | Del Cardayre et al. |
| 2010/0227375 A1 | 9/2010 | Vind et al. |
| 2010/0330628 A1 | 12/2010 | Thakker et al. |
| 2011/0124060 A1 | 5/2011 | Anthony et al. |
| 2011/0136193 A1 | 6/2011 | Grady et al. |
| 2011/0137002 A1 | 6/2011 | Hauer et al. |
| 2011/0189743 A1 | 8/2011 | Yoshikuni et al. |
| 2011/0244536 A1 | 10/2011 | Nagarajan et al. |
| 2011/0269199 A1 | 11/2011 | Satagopan et al. |
| 2011/0312043 A1 | 12/2011 | Burlew et al. |
| 2011/0312044 A1 | 12/2011 | Anton et al. |
| 2012/0034338 A1 | 2/2012 | Frederiksen et al. |
| 2012/0156735 A1 | 6/2012 | Dauner et al. |
| 2012/0156738 A1 | 6/2012 | Anton et al. |
| 2012/0196002 A1 | 8/2012 | Madrid et al. |
| 2012/0202255 A1 | 8/2012 | Suzuki et al. |
| 2012/0237988 A1 | 9/2012 | Anthony et al. |
| 2012/0322117 A1 | 12/2012 | Anton et al. |

FOREIGN PATENT DOCUMENTS

| | | |
|---|---|---|
| CN | 101481695 | 7/2009 |
| CN | 101565713 | 10/2009 |
| CN | 101792721 | 8/2010 |
| CN | 1958797 | 12/2010 |
| EP | 1775344 | 8/2011 |
| JP | 11290078 | 10/1999 |
| JP | 2004194559 | 7/2004 |
| JP | 2005312426 | 11/2005 |
| JP | 2006136223 | 6/2006 |
| JP | 2007300914 | 11/2007 |
| JP | 2008092849 | 4/2008 |
| JP | 2009254315 | 11/2009 |
| JP | 2009256288 | 11/2009 |
| KR | 2006108327 | 10/2006 |
| KR | 2009016364 | 2/2007 |
| KR | 2009027536 | 3/2009 |
| KR | 2009126680 | 12/2009 |
| WO | WO95/28476 | 10/1995 |
| WO | WO00/61740 | 10/2000 |
| WO | WO01/83773 | 11/2001 |
| WO | WO02/095127 | 11/2002 |
| WO | WO2006/067198 | 6/2006 |
| WO | WO2007/080197 | 7/2007 |
| WO | WO2008/092207 | 8/2008 |
| WO | WO2009/011354 | 1/2009 |
| WO | WO2009/077523 | 6/2009 |
| WO | WO2009/093118 | 7/2009 |
| WO | WO2009/115660 | 9/2009 |
| WO | WO2010/005235 | 1/2010 |

OTHER PUBLICATIONS

Oliveira, et al., "In situ recovery of ethanol by extraction and enzymatic esterification," *Mededelingen Faculteit Landbouwwetenschappan Rijksuniversiteit Gent* 63/64a: 1231-1238 (1998).

Brocca et al., "Design, total synthesis, and functional overexpression of the *Candida rugosa* lip 1 gene coding for a major industrial lipase," Protein Sci. 7:1415-22 (1998).

Eisenhaber et al., "A sensitive predictor for potential GPI lipid modification sites in fungal protein sequences and its application to genome-wide studies for *Aspergillus nidulans, Candida albicans, Neurospora crassa, Saccharomyces cerevisiae*, and *Schizosaccharomyces pombe*," J. Mol. Biol. 337(2):243-53 (2004).

Feldmann et al., "Pentose metabolism in *Zymomonas mobilis* wild-type and recombinant strains," Appl. Microbiol. Biotechnol. 38:354-61 (1992).

Fukuda et al., "Whole-cell biocatalysts for biodiesel fuel production," Trends Biotechnol. 26:668-73 (2008).

Gietz and Woods, "Yeast transformation by the LiAc/SS Carrier DNA/PEG method," Methods Mol. Biol. 313:107-20 (2006).

Guo et al., "Improving the performance of industrial ethanol-producing yeast by expressing the aspartyl protease on the cell surface," Yeast 27:1017-27 (2010).

Hahnai et al., "Engineered synthetic pathway for isopropanol production in *Escherichia coli*," Appl. Environ. Microbiol. 73:7814-8 (2007).

Holmquist et al., "High-level production of recombinant *Geotrichum candidum* lipases in yeast *Pichia pastoris*," Protein Expr. Purif. 11:35-40 (1997).

Inaba at al., "Efficient synthesis of enantiomeric ethyl lactate by *Candida antarctica* lipase B (CALB)-displaying yeasts," Appl. Microbiol. Biotechnol. 83:859-64 (2009).

Jiang et al., "Efficient display of active lipase LipB52 with a *Pichia pastoris* cell surface display system and comparison with the LipB52 displayed on *Saccharomyces cerevisiae* cell surface," BMC Biotechnol. 8:4 (2008).

Jiang et al., "Cell surface display of functionally active lipases from *Yarrowia lipolytica* in *Pichia pastoris*," Protein Expr. Purif. 56:35-39 (2007).

Jo et al., "Surface display of human lactoferrin using a glycosylphosphatidylinositol-anchored protein of *Saccharomyces cerevisiae* in *Pichia pastoris*," Biotechnol. Lett. 33:1113-20 (2011).

Kalscheuer et al., "Microdiesel: *Escherichia coli* engineered for fuel production," Microbiology 152:2529-36 (2006).

Kohno et al., "Cloning of genomic DNA of *Rhizopus niveus* lipase and expression in the yeast *Saccharomyces cerevisiae*," Biosci. Biotechnol. Biochem. 62:2425-7 (1998).

Kunkel, "Rapid and efficient site-specific mutagenesis without phenotypic selection," Proc. Natl. Acad. Sci. USA 82:488-92 (1985).

Kuroda et al., "Cell surface engineering of yeast for applications in white biotechnology," Biotechnology Lett. 33(1):1-9 (2011).

Kuroda et al., "Enhancement of display efficiency in yeast display system by vector engineering and gene disruption," Appl. Microbiol. Biotechnol. 82:713-9 (2009).

Lilly et al., "Heterologous expression of a *Clostridium* minicellulosome in *Saccharomyces cerevisiae*," FEMS Yeast Res. 9:1236-49 (2009).

Liu et al., "Surface display of active lipase in *Saccharomyces cerevisiae* using Cwp2 as an anchor protein," Biotechnology Lett. 32(2):255-60 (2010).

Liu et al., "Surface display of active lipases Lip7 and Lip8 from *Yarrowia lipolytica* on *Saccharomyces cerevisiae*," Appl. Microbiol. Biotechnol. 88:885-91 (2010).

Lynd et al., "Microbial cellulose utilization: fundamentals and biotechnology," Microbiol. Mol. Biol. Rev. 66:506-77 (2002).

Ma et al., "Plasmid construction by homologous recombination in yeast," Gene 58:201-16 (1987).

Malinowski, "Two-phase partitioning bioreactors in fermentation technology," Biotechnol. Advances 19:525-38 (2001).

(56) References Cited

OTHER PUBLICATIONS

Matsumoto et al., "Construction of yeast strains with high cell surface lipase activity by using novel display systems based on the Flo 1p flocculation functional domain," Appl. Environ. Microbiol. 68(9):4517-22 (2002).

Mormeneo at al., "Efficient secretion of *Bacillus subtilis* lipase A in *Saccharomyces cerevisiae* by translational fusion to the Pir4 cell wall protein," Appl. Microbiol. Biotechnol. 80(3):437-45 (2008).

Nakamura et al., "Codon usage tabulated from international DNA sequence databases: status for the year 2000," Nucleic Acids Res. 28:292- (2000).

Nevoigt et al., "Engineering of promoter replacement cassettes for fine-tuning of gene expression in *Saccharomyces cerevisiae*," Appl. Environ. Microbiol. 72:5266-73 (2006).

Neugnot et al., "The lipase/acyltransferase from *Candida parapsilosis:* molecular cloning and characterization of purified recombinant enzymes," Eur. J. Biochem. 269:1734-45 (2002).

Ohta et al., "Genetic improvement of *Escherichia coli* for ethanol production: chromosomal integration of *Zymomonas mobilis* genes encoding pyruvate decarboxylase and alcohol dehydrogenase II," Appl. Environ. Microbiol. 57:893-900 (1991).

Oldenburg et al., "Recombination-mediated PCR-directed plasmid construction in vivo in yeast," Nucleic Acids Res. 25:451-2 (1997).

Oliveira and Cabral, "Production and extractive biocatalysis of ethanol using microencapsulated yeast cells and lipase system," J. Chem. Tech. Biotechnol. 52:219-25 (1991).

Oliveira et al., "Immobilization of *Saccharomyces cerevisiae* cells and *Rhizomucor miehei* lipase for the production and extractive biocatalysis of ethanol," Bioprocess Eng. 16:349-53 (1997).

Oliveira et al., "Improvement of alcoholic fermentations by simultaneous extraction and enzymatic esterification of ethanol," J. Mol. Catal. B: Enzymatic 5:29-33 (1998).

Oliveira et al., "Effect of extraction and enzymatic esterification of ethanol on glucose consumption by two *Saccharomyces cerevisiae* strains: a comparative study," J. Chem. Technol. Biotechnol. 76:285-90 (2001).

Pan of al., "Expression of *Candida antarctica* lipase B on yeast surface and synthesis of ethyl hexanoate catalyzed by CALB," Sheng Wu Gong Cheng Xue Bao 24:673-8 (2008) (Abstract).

Resina et al., "Engineering of bottlenecks in *Rhizopus oryzae* lipase production in *Pichia pastoris* using the nitrogen source-regulated FLD1 promoter," N. Biotechnol. 25:396-403 (2009).

Robzyk and Kassir, "A simple and highly efficient procedure for rescuing autonomous plasmids from yeast," Nucleic Acids Res. 20:3790 (1992).

Schreuder et al., "Immobilizing proteins on the surface of yeast cells," TIB Tech. 14:115-20 (1996).

Shen and Liao, "Metabolic engineering of *Escherichia coli* for 1-butanol and 1-propanol production via the keto-acid pathways," Metab. Eng. 10:312-20 (2008).

Sherman, "Getting started with yeast," Methods Enzymol. 350:3-41 (2002).

Shiraga et al., "Enhanced reactivity of *Rhizopus oryzae* lipase displayed on yeast cell surfaces in organic solvents: potential as a whole-cell biocatalyst in organic solvents," Appl. Environ. Microbiol. 71:4335-8 (2005).

Su et al., "Surface display of active lipase in *Pichia pastoris* using Sed1 as an anchor protein," Biotechnology Lett. 32(8):1131-6 (2010).

Su et al., "Display of *Candida antarctica* lipase B on *Pichia pastoris* and its application to flavor ester synthesis," Appl. Microbiol. Biotechnol. 86:1493-1501 (2010).

Tanino et al., "Development of yeast cells displaying *Candida antarctica* lipase B and their application to ester synthesis reaction," Appl. Microbiol. Biotechnol. 75:1319-25 (2007).

Tanino et al., "Construction of a *Pichia pastoris* cell-surface display system using Flo 1p anchor system," Biotechnol. Prog. 22:989-93 (2006).

Tanino et al., "Improvement of a *Candida antarctica* lipase B-displaying yeast whole-cell biocatalyst and its application to the polyester synthesis reaction," Appl. Microbiol. Biotechnol. 82:59-66 (2009).

Taylor et al., "The rapid generation of oligonucleotide-directed mutations at high frequency using phosphorothioate-modified DNA," Nucl. Acids Res. 13:8765-85 (1985).

Thongekkaew et al., "Molecular cloning and functional expression of a novel extracellular lipase from the thermotolerant yeast *Candida thermophile,"* FEMS Yeast Res. 7:232-43 (2007).

Ueda et al., "Cell surface engineering of yeast: construction of arming yeast with biocatalyst," J. Biosci. Bioeng. 90:125-36 (2000).

Underwood et al., "Flux through citrate synthase limits the growth of ethanologenic *Escherichia coli* KO11 during xylose fermentation," Appl. Environ. Microbiol. 68:1071-81 (2002).

Van Dijken et al., "An interlaboratory comparison of physiological and genetic properties of four *Saccharomyces cerevisiae* strains," Enzyme Microb. Technol. 26:706-714 (2000).

Washida et al., "Spacer-mediated display of active lipase on the yeast cell surface," Appl. Microbiol. Biotechnol. 56(5-6):681-6 (2001).

Wen et al., "Yeast surface display of trifunctional minicellulosomes for simultaneous saccharafication and fermentation of cellulose to ethanol," Appl. Environ. Microbiol. 76:1251-60 (2010).

Yu et al., "High-level expression of extracellular lipase Lip2 from *Yarrowia lipolytica* in *Pichia pastoris* and its purification and characterization," Protein Expr. Purif. 53:255-63 (2007).

Zhang et al., "Metabolic engineering of a pentose metabolism pathway in ethanologenic *Zymomonas mobilis,"* Science 267:240-3 (1995).

International Search Report and Written Opinion of International Application PCT/US2012/030468, mailed on Oct. 25, 2012.

\* cited by examiner

IN SITU EXPRESSION OF LIPASE FOR ENZYMATIC PRODUCTION OF ALCOHOL ESTERS DURING FERMENTATION

CROSS-REFERENCE TO RELATED APPLICATIONS

This application is a continuation-in-part of and claims the benefit of priority of U.S. application Ser. No. 13/427,987 filed on Mar. 23, 2012, which claims the benefit of priority of U.S. Provisional Patent Application No. 61/466,712, filed Mar. 23, 2011 and U.S. Provisional Patent Application No. 61/498,292, filed Jun. 17, 2011. The contents of the referenced applications are herein incorporated by reference in their entireties.

REFERENCE TO SEQUENCE LISTING SUBMITTED ELECTRONICALLY

The content of the electronically submitted sequence listing in ASCII text file (Name: 20120615_CL5145USCIP_SeqList_ST25.txt, Size: 637,685 bytes, and Date of Creation: Jun. 14, 2012) filed with the application is incorporated herein by reference in its entirety.

FIELD OF THE INVENTION

The present invention relates to the fermentative production of alcohols, including ethanol and butanol, and processes for improving alcohol fermentation employing in situ product removal methods.

BACKGROUND OF THE INVENTION

Alcohols have a variety of applications in industry and science. For example, alcohols can be used as a beverage (i.e., ethanol), fuel, reagents, solvents, and antiseptics. For example, butanol is an alcohol that is an important industrial chemical with a variety of applications, including use as a fuel additive, as a feedstock chemical in the plastics industry, and as a food-grade extractant in the food and flavor industry. Accordingly, there is a high demand for alcohols, such as butanol, as well as for efficient production methods which do not rely on non-renewable resources.

Production of alcohol utilizing fermentation by microorganisms is one such production method which utilizes substrates from renewable feedstocks. In the production of butanol in particular, some microorganisms that produce butanol in high yields also have low butanol toxicity thresholds, such that butanol needs to be removed from the fermentation vessel as it is being produced. Thus, there is a continuing need to develop efficient methods and systems for producing butanol in high yields despite low butanol toxicity thresholds of the butanol-producing microorganisms in the fermentation medium. In situ product removal (ISPR) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction (U.S. Patent Appl. Pub. No. 20090305370). In general, with regard to butanol fermentation, for example, the fermentation medium is contacted with an organic extractant. The organic extractant and the fermentation medium form a biphasic mixture. The butanol partitions into the organic extractant phase, decreasing the concentration in the aqueous phase which contacts the microorganism, thereby limiting the exposure of the microorganism to the inhibitory butanol. Liquid-liquid extraction results from contact between the extractant and the fermentation broth for transfer of the product alcohol into the extractant; separation of the extractant phase from the aqueous phase; and, preferably, recycle of the extractant with minimal degradation of the partition coefficient of the extractant over a long-term operation.

The extractant can become contaminated over time with each recycle by, for example, the build-up of lipids present in the biomass that is fed to the fermentation vessel as feedstock of hydrolysable starch. As an example, a liquified corn mash loaded to a fermentation vessel can result in a fermentation broth that contains corn oil during conversion of glucose to butanol by simultaneous saccharification and fermentation (with saccharification of the liquified mash occurring during fermentation by the addition of glucoamylase to produce glucose). The dissolution of the corn oil lipids into an extractant during ISPR can result in build-up of lipid concentration with each extractant recycle, decreasing the partition coefficient for the product alcohol in extractant as the lipid concentration in extractant increases with each recycle.

Converting the lipids present in a liquefied mash into an extractant that can be used in ISPR is a method of decreasing the amount of lipids that are fed to the fermentation vessel, as is esterifying the product alcohol as it is produced during the fermentation with a fatty acid by adding lipase as an esterification catalyst to the fermentation. Such methods are described for example in US Appl. Pub. Nos. 20110312044 and 20110312043, and PCT Appl. Pub. No. WO2011/159998, which are herein incorporated by reference.

There is a continuing need for alternative extractive fermentation methods which can also reduce costs associated with adding lipase to the fermentation.

SUMMARY OF THE INVENTION

Provided herein are methods comprising: a) providing a fermentation medium comprising fermentable carbon substrate derived from a biomass feedstock, alcohol produced from a fermentable carbon substrate derived from a biomass feedstock, and an alcohol producing microorganism wherein the alcohol producing microorganism comprises a polynucleotide encoding a polypeptide having lipase activity and the microorganism expresses and displays or secretes said polypeptide such that the lipase activity is present in the fermentation medium; b) contacting the fermentation medium with a carboxylic acid; wherein the lipase activity is present in the fermentation medium in sufficient amount to convert at least a portion of the alcohol produced by the microorganism to alcohol esters extracellularly. In embodiments, the alcohol producing microorganism is yeast. In embodiments, the polynucleotide encoding a polypeptide having lipase activity is engineered. In embodiments, the methods further comprise contacting the fermentation medium with an extractant to form a two-phase mixture comprising an aqueous phase and an organic phase. In embodiments, the extractant comprises the carboxylic acid. In embodiments, the product alcohol is a $C_2$ to $C_8$ alkyl alcohol. In embodiments, the product alcohol is ethanol. In embodiments, the alcohol esters comprise fatty acid ethyl esters. In embodiments, the product alcohol is butanol. In embodiments, the alcohol esters comprise fatty acid butyl esters. In embodiments, the alcohol esters further comprise fatty acid ethyl esters.

In embodiments, polypeptides provided herein having lipase activity are displayed on the surface of the microorganism. In embodiments, polypeptides having lipase activity are secreted. In embodiments, the polypeptide having lipase activity comprises a sequence having at least about 70% identity, at least about 80% identity, at least about 90% identity, or at least about 95% identity to any one of SEQ ID NOs: 249, 250, 251, 252, 253 or a fragment thereof. In embodiments, the polynucleotide encoding a polypeptide having lipase activity comprises a sequence with at least about 70% identity to a polynucleotide having SEQ ID NO: 1, 3, 5, 7, 8, 9, 46, 48, 50, 52, 54, 255, 271 or 273. In embodiments, the polypeptide having lipase activity comprises a sequence with at least about 70% identity, at least about 80% identity, at least about 90% identity, or at least about 95% identity to a polypeptide having SEQ ID NO: 2, 4, 6, 256, 47, 49, 51, 53, 55, 241, 242, 243, 244, 245, 246, 247, 248, 272, or 274 or an active fragment thereof. In embodiments, the polypeptide having lipase activity does not contain a glycosylation motif. In embodiments, the polypeptide having lipase activity is not glycosylated.

In embodiments, the carboxylic acid comprises free fatty acids derived from corn oil, canola oil, palm oil, linseed oil, jatropha oil, or soybean oil. In embodiments, the carboxylic acid is derived from the same biomass feedstock as the fermentable carbon substrate. In embodiments, the carboxylic acid comprises carboxylic acids having $C_{12}$ to $C_{22}$ linear or branched aliphatic chains. In embodiments, the contacting with extractant and the contacting with carboxylic acid occur contemporaneously. In embodiments, at least about 60% of the effective titer of alcohol produced by the microorganism is converted to alcohol esters. In embodiments, the fermentation medium further comprises triglycerides, diglycerides, monoglycerides, and phospholipids, or combinations thereof and the lipase activity hydrolyzes at least a portion of the triglycerides, diglycerides, monoglycerides, and phospholipids, or combinations thereof to form free fatty acids.

In embodiments, the effective titer of alcohol produced during a fermentation is greater than that produced during a fermentation by an alcohol-producing microorganism that does not comprise a polynucleotide encoding a polypeptide having lipase activity and the microorganism expresses and secretes or displays said polypeptide such that the lipase activity is present in the fermentation medium. In embodiments, the effective rate of alcohol produced during a fermentation is greater than the rate of alcohol production during a fermentation by an alcohol-producing microorganism that does not comprise a polynucleotide encoding a polypeptide having lipase activity and the microorganism expresses and secretes or displays said polypeptide such that the lipase activity is present in the fermentation medium.

Also provided herein are recombinant host cells comprising an engineered alcohol production pathway; and an engineered polynucleotide encoding a polypeptide having lipase activity. In embodiments, the polypeptide having lipase activity comprises a sequence having at least about 70% identity, at least about 80% identity, at least about 90% identity, or at least about 95% identity to SEQ ID NO: 2, 4, 6, 256, 47, 49, 51, 53, 55, 241, 242, 243, 244, 245, 246, 247, 248, 272, or 274 or an active fragment thereof. In embodiments, the polypeptide having lipase activity comprises a sequence having at least about 70% identity, at least about 80% identity, at least about 90% identity, or at least about 95% identity to any one of SEQ ID NOs: 249, 250, 251, 252, 253 or a fragment thereof. In embodiments, the polypeptide having lipase activity does not contain a glycosylation motif. In embodiments, the polypeptide having lipase activity is not glycosylated. In embodiments, the engineered polynucleotide encoding a polypeptide having lipase activity comprises a sequence having at least about 70% identity, at least about 80% identity, at least about 90% identity, or at least about 95% identity to SEQ ID NO: 1, 3, 5, 7, 8, 9, 46, 48, 50, 52, 54, 255, 271 or 273.

Also provided herein are recombinant host cells comprising an alcohol production pathway; and an engineered polynucleotide encoding a polypeptide having lipase activity wherein the polypeptide having lipase activity comprises a sequence having at least about 70% identity, at least about 80% identity, at least about 90% identity, or at least about 95% identity to SEQ ID NO: 2, 4, 6, 256, 47, 49, 51, 53, 55, 241, 242, 243, 244, 245, 246, 247, 248, 272, or 274 or an active fragment thereof. In embodiments, the polypeptide having lipase activity further comprises a sequence having at least about 70% identity, at least about 80% identity, at least about 90% identity, or at least about 95% identity to any one of SEQ ID NOs: 249, 250, 251, 252, 253 or a fragment thereof. In embodiments, the alcohol production pathway is a butanol production pathway. In embodiments, the butanol production pathway is an isobutanol production pathway. In embodiments, the host cell further comprises reduced or eliminated pyruvate decarboxylase activity.

Also provided herein are methods of increasing tolerance of an alcohol-producing microorganism to the produced alcohol, the methods comprising: engineering a microorganism to express and secrete or display a polypeptide having lipase activity; contacting the engineered microorganism with triglycerides, diglycerides, monoglycerides, phospholipids, free fatty acids, or a mixture thereof and a carbon substrate under conditions whereby the microorganism produces an alcohol. In embodiments, the engineered microorganism is contacted with triglycerides, diglycerides, monoglycerides, and phospholipids, or combinations thereof and wherein the secreted or displayed lipase converts at least a portion of the trigylcerides, diglycerides, monoglycerides, and phospholipids, or combinations thereof into free fatty acids. In embodiments, the lipase catalyzes the formation of alcohol esters. In embodiments, the microorganism produces alcohol at an effective titer greater than that produced by a microorganism that has not been engineered to express and secrete a polypeptide with lipase activity. In embodiments, the microorganism further comprises an engineered alcohol biosynthetic pathway. In embodiments, the engineered alcohol biosynthetic pathway is a 1-butanol, a 2-butanol, or an isobutanol biosynthetic pathway. In embodiments, the isobutanol biosynthetic pathway comprises the following substrate to product conversions: pyruvate to acetolactate, acetolactate to 2,3-dihydroxyisovalerate, 2,3-dihydroxyisovalerate to 2-ketoisovalerate, 2-ketoisovalerate to isobutyraldehyde; and, isobutyraldehyde to isobutanol.

Provided herein are methods of producing butyl esters during a fermentation comprising providing a fermentation medium comprising a carbon substrate and triglycerides, diglycerides, monoglycerides, and phospholipids, or a mixture thereof; and contacting the fermentation medium with an alcohol-producing microorganism comprising a butanol biosynthetic pathway wherein said microorganism further comprises an engineered polynucleotide encoding a polypeptide having lipase activity and which expresses and secretes or displays the polypeptide such that the lipase activity is present in the fermentation medium. In embodiments, the fermentation medium further comprises one or more carboxylic acids. In embodiments, the carbon substrate is derived from biomass. In embodiments, the biomass is corn or sugar cane. In embodiments, the carbon substrate and the triglycerides diglycerides, monoglycerides, and phospholipids are derived from the same biomass.

Provided herein are fermentation media comprising an alcohol-producing microorganism comprising a butanol biosynthetic pathway and further comprising an engineered polynucleotide encoding a polypeptide having lipase activity which is expressed and secreted or displayed, butyl esters, and butanol.

Also provided are animal feed products comprising a microorganisms described herein.

BRIEF DESCRIPTION OF THE DRAWINGS AND SEQUENCES

The accompanying drawings and sequence listing, which are incorporated herein and form a part of the specification, illustrate the present invention and, together with the description, further serve to explain the principles of the invention and to enable a person skilled in the pertinent art to make and use the invention.

FIG. 1 schematically illustrates an exemplary method and system of the present invention, in which a microorganism is supplied to a fermentation vessel along with carboxylic acid and/or native oil.

Figure 2:
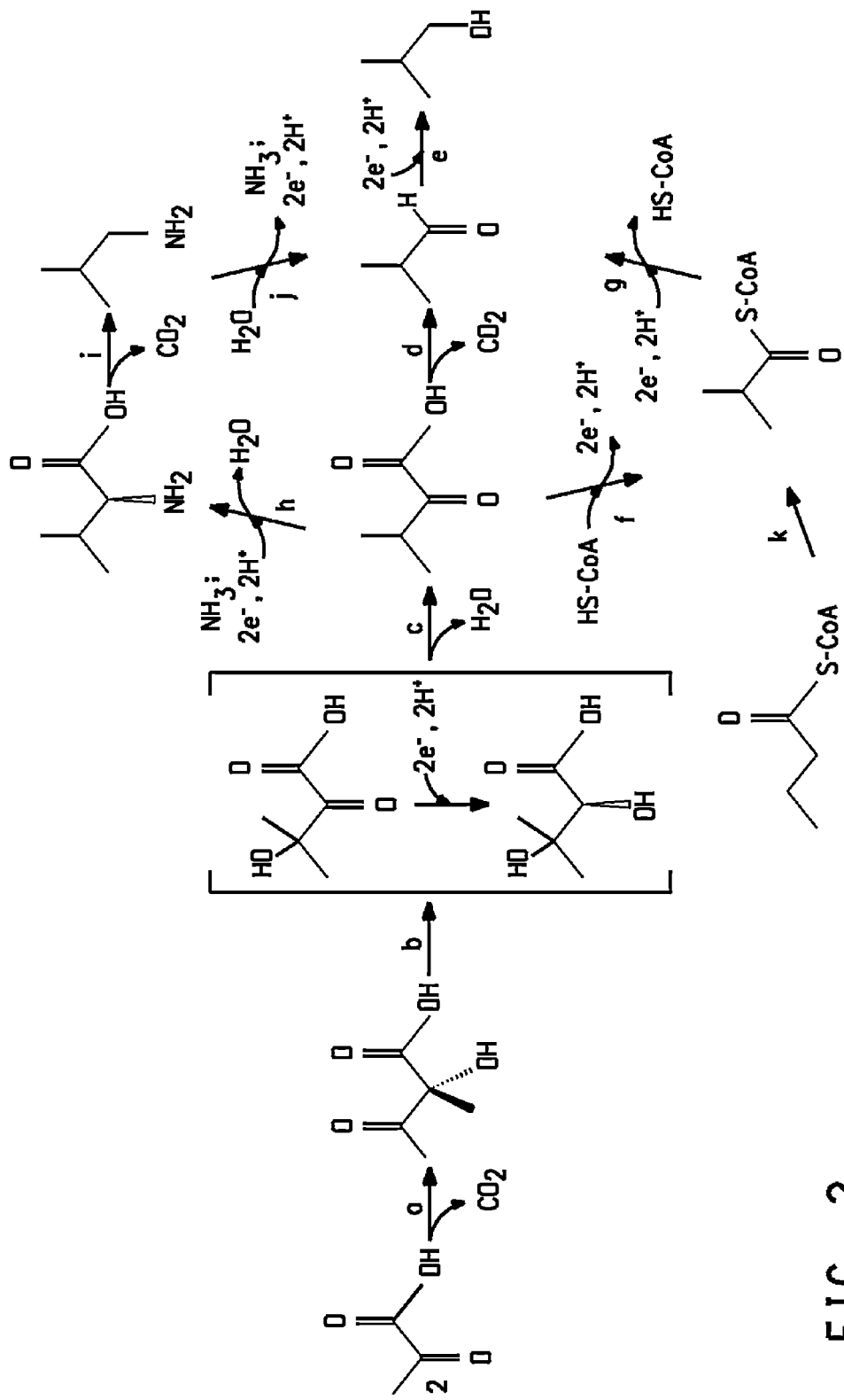

FIG. 2 depicts example biosynthetic pathways for biosynthesis of isobutanol from pyruvate.

Figure 3:
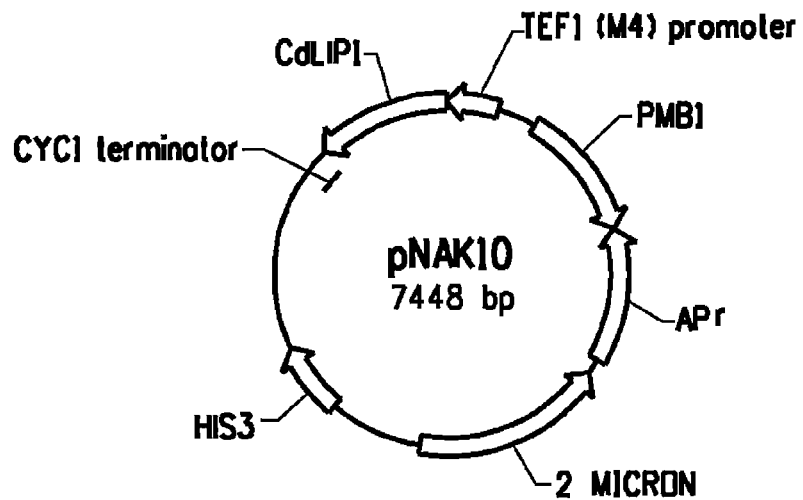

FIG. 3 is a map of plasmid pRS423::TEF1(M4)-CdLIP1 ("pNAK10"; SEQ ID NO: 45; see Example 1), bearing the *Candida deformans* LIP1 lipase under transcriptional control of the constitutive TEF1(M4) promoter (Nevoigt E, Kohnke J, Fischer C R, Alper H, Stahl U, & Stephanopoulos G (2006), Engineering of promoter replacement cassettes for fine-tuning of gene expression in *Saccharomyces cerevisiae*. Appl Environ Microbiol 72:5266-5273) and the CYC1 transcriptional terminator, in a yeast-*E. coli* shuttle vector.

Figure 4:
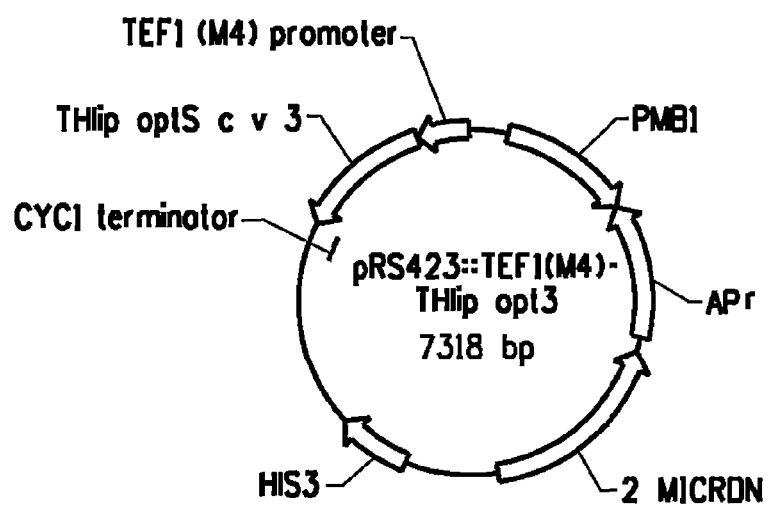

FIG. 4 is a map of plasmid pRS423::TEF1(M4)-THlip ("pTVAN2"; SEQ ID NO: 100; see Example 2), bearing the *Thermomyces lanuginosus* Tlan lipase under transcriptional control of the constitutive TEF1(M4) promoter (Nevoigt E, et al.) and the CYC1 transcriptional terminator, in a yeast-*E. coli* shuttle vector.

Figure 5:
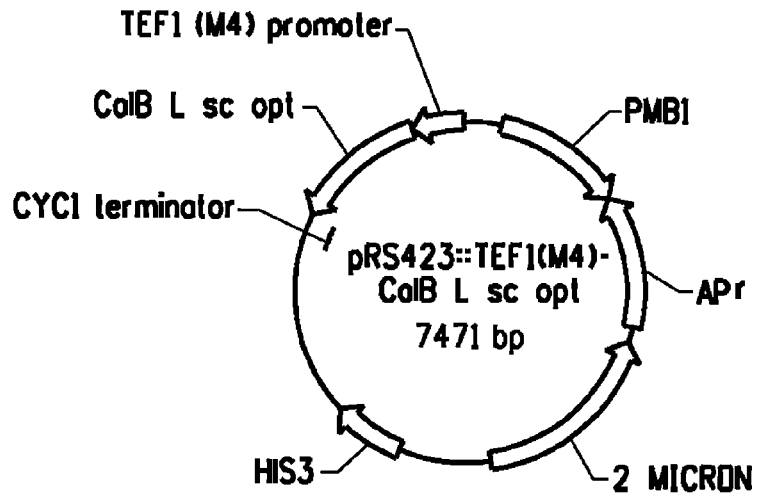

FIG. 5 is a map of plasmid pRS423::TEF1(M4)-CalB ("pTVAN3"; SEQ ID NO: 101; See Example 7), bearing the *Candida antarctica* CalB lipase under transcriptional control of the constitutive TEF1(M4) promoter (Nevoigt E, et al.) and the CYC1 transcriptional terminator, in a yeast-*E. coli* shuttle vector.

Figure 6:
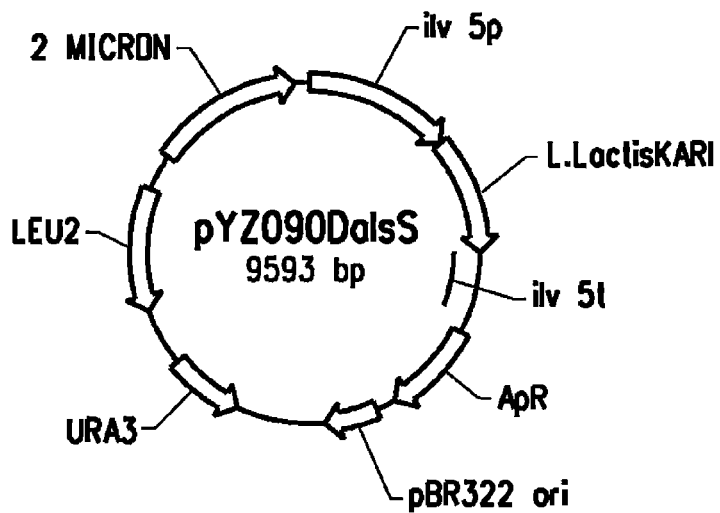

FIG. 6 is a map of plasmid pYZ090ΔalsS (SEQ ID NO: 43; see Examples), which bears the ketol-acid reductoisomerase (KAR1) enzyme ORF in a yeast-*E. coli* shuttle vector.

Figure 7:
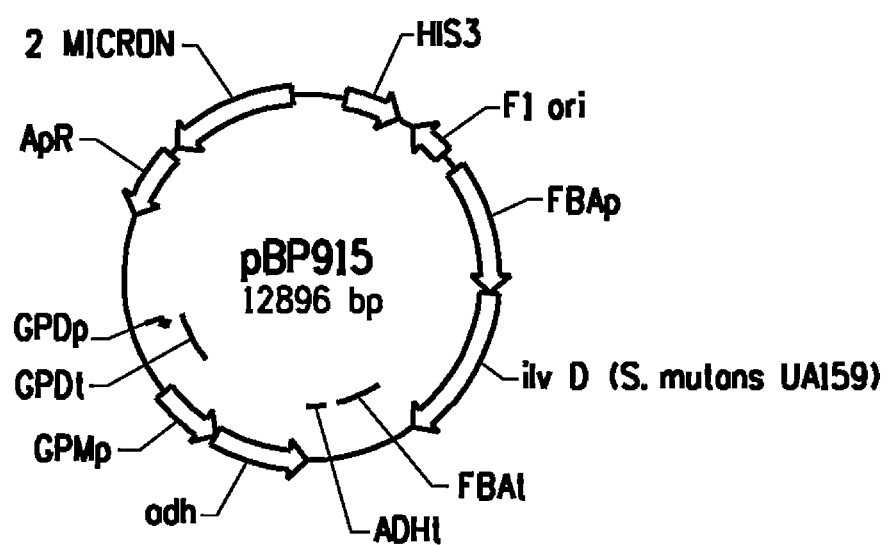

FIG. 7. Map of plasmid pBP915 (SEQ ID NO: 44; see Examples 9 and 10), which bears the ORFs encoding the dihydroxyacid dehydratase enzyme and the alcohol dehydrogenase enzyme in a yeast-*E. coli* shuttle vector.

SEQ ID NOs: 1 and 2 are nucleic acid and amino acid sequences for lipase B ("CalB") from *Candida antarctica*.

SEQ ID NOs: 3 and 4 are nucleic acid and amino acid sequences for lipase 1 ("LIP1") from *Candida deformans*.

SEQ ID NOs: 5 and 6 are nucleic acid and amino acid sequences for Tlan lipase ("Tlan") from *Thermomyces lanuginosus*.

SEQ ID NOs: 255 and 256 are nucleic acid and amino acid sequences for lipase 3 ("lip3") from *Aspergillus tubingensis*.

SEQ ID NOs: 7, 8, 9, and 257 are coding sequences for CalB, LIP1, Tlan, and lip3 lipases from *Candida antarctica, Candida deformans, Thermomyces lanuginosus,* and *Aspergillus tubingensis*, codon-optimized for expression in *S. cerevisiae*.

SEQ ID NOs: 46 and 47 are nucleic acid and amino acid sequences for a CalB variant with the modification N99A.

SEQ ID NOs: 48 and 49 are nucleic acid and amino acid sequences for a LIP1 variant with the modification N146A.

SEQ ID NOs: 50 and 51 are nucleic acid and amino acid sequences for a LIP1 variant with the modification N167A.

SEQ ID NOs: 52 and 53 are nucleic acid and amino acid sequences for a LIP1 variant with the modifications N146A and N167A.

SEQ ID NOs: 54 and 55 are nucleic acid and amino acid sequences for a Tlan variant with the modification N55A.

SEQ ID NOs: 271 and 272 are nucleic acid and amino acid sequences for a lip3 variant with the modification N59A.

SEQ ID NOs: 273 and 274 are nucleic acid and amino acid sequences for a lip3 variant with the modification N269A.

SEQ ID NOs: 275 and 276 are nucleic acid and amino acid sequences for a lip3 variant with the modifications N59A and N269A.

SEQ ID NOs: 241 and 248 are amino acid sequences for lipases from *Aspergillus kawachii, Aspergillus niger, Yarrowia lipolytica, Talaromyces thermophilus*.

SEQ ID NOs: 249 and 254 are amino acid sequences of cell surface anchor domains of *S. cerevisiae*.

SEQ ID NOs: 258 and 259 are the amino acid sequences of alcohol dehydrogenase enzymes from *Achromobacter xylosoxidans* and *Beijerinkia indica*.

SEQ ID NOs: 260 and 261 are the amino acid sequences of keto-acid decarboxylases from *Lactococcus lactis* and *Listeria grayi*.

SEQ ID NOs: 262 and 263 are the amino acid sequences of dihydroxyacid dehdratases from *Streptococcus mutans* and *Lactococcus lactis*.

SEQ ID NOs: 10-45, 56-144, 153-238, 240, 264-270, and 278 are sequences of synthetic constructs and primers described in the Examples.

DETAILED DESCRIPTION

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

In order to further define this invention, the following terms and definitions are herein provided.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances, i.e., occurrences of the element or component. Therefore "a" or "an"

should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about", the claims include equivalents to the quantities. In one embodiment, the term "about" means within 10% of the reported numerical value, alternatively within 5% of the reported numerical value.

"Biomass" as used herein refers to a natural product containing hydrolysable polysaccharides that provide fermentable sugars, including any sugars and starch derived from natural resources such as corn, sugar cane, wheat, cellulosic or lignocellulosic material and materials comprising cellulose, hemicellulose, lignin, starch, oligosaccharides, disaccharides and/or monosaccharides, and mixtures thereof. Biomass may also comprise additional components, such as protein and/or lipids. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, rye, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof. For example, mash or juice or molasses or hydrolysate may be formed from biomass by any processing known in the art for processing the biomass for purposes of fermentation, such as by milling, treating and/or liquefying and comprises fermentable sugar and may comprise an amount of water. For example, cellulosic and/or lignocellulosic biomass may be processed to obtain a hydrolysate containing fermentable sugars by any method known to one skilled in the art. A low ammonia pretreatment is disclosed in US Patent Application Publication US20070031918A1, which is herein incorporated by reference. Enzymatic saccharification of cellulosic and/or lignocellulosic biomass typically makes use of an enzyme consortium for breaking down cellulose and hemicellulose to produce a hydrolysate containing sugars including glucose, xylose, and arabinose. (Saccharification enzymes suitable for cellulosic and/or lignocellulosic biomass are reviewed in Lynd, L. R., et al. (Microbiol. Mol. Biol. Rev., 66:506-577, 2002).

Mash or juice or molasses or hydrolysate may include feedstock 12 and feedstock slurry 16 as described herein. An aqueous feedstream may be derived or formed from biomass by any processing known in the art for processing the biomass for purposes of fermentation, such as by milling, treating and/or liquefying and comprises fermentable carbon substrate (eg. sugar) and water. An aqueous feedstream may include feedstock 12 and feedstock slurry 16 as described herein.

"Product alcohol" as used herein refers to any alcohol that can be produced by a microorganism in a fermentation process that utilizes biomass as a source of fermentable carbon substrate. Product alcohols include, but are not limited to, $C_1$ to $C_5$ alkyl alcohols. In embodiments, the product alcohols are $C_2$ to $C_5$ alkyl alcohols. In additional embodiments, the product alcohols are $C_2$ to $C_5$ alkyl alcohols. It will be appreciated that $C_1$ to $C_5$ alkyl alcohols include, but are not limited to, methanol, ethanol, propanol, butanol, and pentanol. Likewise $C_2$ to $C_5$ alkyl alcohols include, but are not limited to, ethanol, propanol, butanol, and pentanol. "Alcohol" is also used herein with reference to a product alcohol.

"Butanol" as used herein refers with specificity to the butanol isomers 1-butanol (1-BuOH), 2-butanol (2-BuOH) and/or isobutanol (iBuOH or i-BuOH or I-BUOH, also known as 2-methyl-1-propanol), either individually or as mixtures thereof.

"Propanol" as used herein refers to the propanol isomers isopropanol or 1-propanol.

"Pentanol" as used herein refers to the pentanol isomers 1-pentanol, 3-methyl-1-butanol, 2-methyl-1-butanol, 2,2-dimethyl-1-propanol, 3-pentanol, 2-pentanol, 3-methyl-2-butanol, or 2-methyl-2-butanol.

"In Situ Product Removal (ISPR)" as used herein means the selective removal of a specific fermentation product from a biological process such as fermentation to control the product concentration in the biological process as the product is produced.

"Fermentable carbon source" or "fermentable carbon substrate" as used herein means a carbon source capable of being metabolized by the microorganisms disclosed herein for the production of fermentative alcohol. Suitable fermentable carbon sources include, but are not limited to, monosaccharides, such as glucose or fructose; disaccharides, such as lactose or sucrose; oligosaccharides; polysaccharides, such as starch or cellulose; one carbon substrates including methane; and mixtures thereof.

"Feedstock" as used herein means a feed in a fermentation process, the feed containing a fermentable carbon source with or without undissolved solids, and where applicable, the feed containing the fermentable carbon source before or after the fermentable carbon source has been liberated from starch or obtained from the breakdown of complex sugars by further processing, such as by liquefaction, saccharification, or other process. Feedstock includes or is derived from a biomass. Suitable feedstocks include, but are not limited to, rye, wheat, corn, cane and mixtures thereof.

"Undissolved solids" as used herein means non-fermentable portions of feedstock, for example germ, fiber, and gluten.

"Fermentation broth" as used herein means the mixture of water, sugars, dissolved solids, microorganisms producing alcohol, product alcohol and all other constituents of the material held in the fermentation vessel in which product alcohol is being made by the reaction of sugars to alcohol, water and carbon dioxide ($CO_2$) by the microorganisms present.

From time to time, as used herein the term "fermentation medium" and "fermented mixture" can be used synonymously with "fermentation broth".

"Fermentation vessel" as used herein means the vessel in which the fermentation reaction by which product alcohol such as butanol is made from sugars is carried out.

The term "effective titer" as used herein, refers to the total amount of a particular alcohol (e.g., butanol) produced by fermentation or alcohol equivalent of the alcohol ester produced by alcohol esterification per liter of fermentation medium. For example, the effective titer of butanol in a unit volume of a fermentation includes: (i) the amount of butanol in the fermentation medium; (ii) the amount of butanol recovered from the organic extractant; (iii) the amount of butanol recovered from the gas phase, if gas stripping is used, and (iv) the alcohol equivalent of the butanol ester in either the organic or aqueous phase.

"Saccharification" as used herein means the break down of oligosaccharides into monosaccharides. "Simultaneous saccharification and fermentation" means fermentation and saccharification occur concurrently in the same vessel.

As used herein, "saccharification enzyme" means one or more enzymes that are capable of hydrolyzing polysaccharides and/or ologosaccharides, e.g, alpha-1,4-glucosidic bonds of glycogen, starch. Saccharification enzymes may include enzymes capable of hydrolyzing cellulosic or lignocellulosic materials as well.

As used herein, "lipase activity" means the enzymatic activity of catalyzing the hydrolysis of ester chemical bonds in water-insoluble or poorly water soluble lipid substrates. Lipases are a subclass of the esterases, and as such, "lipase activity" also means the enzymatic activity of catalyzing the hydrolysis of an ester into a carboxylic acid and an alcohol, and, as used herein, "lipase activity" also means the enzymatic activity of esterifying alcohol and carboxylic acid into an alcohol ester of a carboxylic acid.

As used herein, "glycosylation" is the enzymatic addition of carbohydrate molecules to biological macromolecules such as proteins, which can occur when proteins are targeted for secretion out of the cell. In O-glycosylation of proteins, the carbohydrates are attached to the hydroxyl groups of serine, threonine, or tyrosine residues. In N-glycosylation of proteins, the carbohydrates are attached to the amide side chain of asparagine (N) residues in the consensus sequence NXS/T, where X is any amino acid and S/T is serine or threonine. "Glycosylated" as used herein refers to a protein molecule with carbohydrates covalently attached.

"Liquefaction vessel" as used herein means the vessel in which liquefaction is carried out. Liquefaction is the process in which oligosaccharides are liberated from the feedstock. In embodiments where the feedstock is corn, oligosaccharides are liberated from the corn starch content during liquefaction.

The term "separation" as used herein is synonymous with "recovery" and refers to removing a chemical compound from an initial mixture to obtain the compound in greater purity or at a higher concentration than the purity or concentration of the compound in the initial mixture.

The terms "water-immiscible" or "insoluble" refer to a chemical component, such as an extractant or solvent, which is incapable of mixing with an aqueous solution, such as a fermentation broth, in such a manner as to form one liquid phase.

"Extractant" or "ISPR extractant" as used herein means an organic solvent used to extract any product alcohol such as butanol, or used to extract any product alcohol ester produced by a catalyst from a product alcohol and a carboxylic acid or lipid. From time to time, as used herein the term "solvent" may be used synonymously with "extractant". For the processes described herein, extractants are water-immiscible.

"Native oil" as used herein refers to lipids obtained from plants (e.g., biomass) or animals. "Plant-derived oil" as used herein refers to lipids obtained from plants in particular. From time to time, "lipids" may be used synonymously with "oil" and "acyl glycerides." Native oils include, but are not limited to, tallow, corn, canola, capric/caprylic triglycerides, castor, coconut, cottonseed, fish, jojoba, lard, linseed, neetsfoot, oiticica, palm, peanut, rapeseed, rice, safflower, soya, sunflower, tung, jatropha and vegetable oil blends.

The term "organic phase", as used herein, refers to the non-aqueous phase of a biphasic mixture obtained by contacting a fermentation broth with a water-immiscible organic extractant.

The term "fatty acid" as used herein refers to a carboxylic acid (e.g., aliphatic monocarboxylic acid) having $C_4$ to $C_{28}$ carbon atoms (most commonly $C_{12}$ to $C_{24}$ carbon atoms), which is either saturated or unsaturated. Fatty acids may also be branched or unbranched. Fatty acids may be derived from, or contained in esterified form, in an animal or vegetable fat, oil, or wax. Fatty acids may occur naturally in the form of glycerides in fats and fatty oils or may be obtained by hydrolysis of fats or by synthesis. The term fatty acid may describe a single chemical species or a mixture of fatty acids. Fatty acids may comprise a mixture of both protonated and unprotonated fatty acids, wherein the unprotonated fatty acids are salts (e.g., sodium, potassium, ammonium or calcium ion salts) of unprotonated fatty acids. In addition, the term fatty acid also encompasses free fatty acids.

The term "fatty alcohol" as used herein refers to an alcohol having an aliphatic chain of $C_4$ to $C_{22}$ carbon atoms, which is either saturated or unsaturated.

The term "fatty aldehyde" as used herein refers to an aldehyde having an aliphatic chain of $C_4$ to $C_{22}$ carbon atoms, which is either saturated or unsaturated.

The term "carboxylic acid" as used herein refers to any organic compound with the general chemical formula —COOH in which a carbon atom is bonded to an oxygen atom by a double bond to make a carbonyl group (—C=O) and to a hydroxyl group (—OH) by a single bond. A carboxylic acid may be in the form of the protonated carboxylic acid, or in the form of a salt of a carboxylic acid (for example, an ammonium, sodium or potassium salt), or as a mixture of protonated carboxylic acid and salt of a carboxylic acid. The term carboxylic acid may describe a single chemical species (e.g., oleic acid), or a mixture of carboxylic acids as can be produced, for example, by the hydrolysis of biomass-derived fatty-acid esters or triglycerides, diglycerides, monoglyerides and phopholipids.

The term "butanol biosynthetic pathway" or "butanol production pathway" as used herein refers to an enzyme pathway to produce 1-butanol, 2-butanol, or isobutanol.

The term "1-butanol biosynthetic pathway" or "1-butanol production pathway" as used herein refers to an enzyme pathway to produce 1-butanol from acetyl-coenzyme A (acetyl-CoA).

The term "2-butanol biosynthetic pathway" or "2-butanol production pathway" as used herein refers to an enzyme pathway to produce 2-butanol from pyruvate.

The term "isobutanol biosynthetic pathway" or "isobutanol production pathway" as used herein refers to an enzyme pathway to produce isobutanol from pyruvate.

The term "alcohol biosynthetic pathway" or "alcohol production pathway" as used herein refers to an enzymatic pathway to convert a carbon substrate to an alcohol. A recombinant host cell comprising an "engineered alcohol production pathway" refers to a host cell containing a modified pathway that produces alcohol in a manner different than that normally present in the host cell. Such differences include production of an alcohol not typically produced by the host cell, or increased or more efficient production.

The term "gene" refers to a nucleic acid fragment that is capable of being expressed as a specific protein, optionally including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene (i.e, it is modified from its native state or is from another source), comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign gene" or "heterologous gene" refers to a gene not normally found as a native gene in the host organism, but that is introduced into the host organism by gene transfer. Foreign genes can comprise native genes inserted into a non-native organism, or chimeric genes.

As used herein the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, translation leader sequences, introns, polyadenylation recognition sequences, RNA processing sites, effector binding sites and stem-loop structures.

The term "polynucleotide" is intended to encompass a singular nucleic acid as well as plural nucleic acids, and refers to a nucleic acid molecule or construct, e.g., messenger RNA (mRNA) or plasmid DNA (pDNA). As used herein, a "gene" is a polynucleotide. A polynucleotide can contain the nucleotide sequence of the full-length gene or cDNA sequence, or a fragment thereof, including the untranslated 5' and 3' sequences and the coding sequences. The polynucleotide can be composed of any polyribonucleotide or polydeoxyribonucleotide, which may be unmodified RNA or DNA or modified RNA or DNA (e.g. heterologous DNA). For example, polynucleotides can be composed of single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. "Polynucleotide" embraces chemically, enzymatically, or metabolically modified forms.

"Engineered polynucleotide" as used herein refers to a polynucleotide that has been modified from a form found in nature or that is introduced into a host organism by gene transfer such as by transformation. Such modification includes, for example, linking two sequences not found linked in nature, such as operably linking a coding sequence with a promoter not found operably linked with the coding sequence in nature, or linking two coding sequences together to create a chimeric coding sequence. Such modification also includes creating one or more nucleotide changes, including base substitutions, insertions, or deletions, to a polynucleotide found in nature.

A polynucleotide sequence may be referred to as "isolated," in which it has been removed from its native environment. For example, a heterologous polynucleotide encoding a polypeptide or polypeptide fragment having dihydroxy-acid dehydratase activity contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA may be comprised of one or more segments of cDNA, genomic DNA or synthetic DNA.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. A polypeptide may be derived from a natural biological source or produced by recombinant technology, but is not necessarily translated from a designated nucleic acid sequence. It may be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposed of the invention, as are native or recombinant polypeptides which have been separated, fractionated, or partially or substantially purified by any suitable technique.

As used herein, "recombinant microorganism" refers to microorganisms, such as bacteria or yeast, that are modified by use of recombinant DNA techniques, such as by engineering a host cell to comprise a biosynthetic pathway such as butanol.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts, refers to the alteration of codons in the gene or coding regions of the nucleic acid molecules to reflect the typical codon usage of the host organism without altering the polypeptide encoded by the DNA. Such optimization includes replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F) | TCT Ser (S) | TAT Tyr (Y) | TGT Cys (C) |
|   | TTC Phe (F) | TCC Ser (S) | TAC Tyr (Y) | TGC |
|   | TTA Leu (L) | TCA Ser (S) | TAA Stop | TGA Stop |
|   | TTG Leu (L) | TCG Ser (S) | TAG Stop | TGG Trp (W) |
| C | CTT Leu (L) | CCT Pro (P) | CAT His (H) | CGT Arg (R) |
|   | CTC Leu (L) | CCC Pro (P) | CAC His (H) | CGC Arg (R) |
|   | CTA Leu (L) | CCA Pro (P) | CAA Gln (Q) | CGA Arg (R) |
|   | CTG Leu (L) | CCG Pro (P) | CAG Gln (Q) | CGG Arg (R) |
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met (M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database" available at http://www.kazusa.or.jp/codon/ (visited Mar. 20, 2008), and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table 2. This table uses mRNA nomenclature, and so instead of thymine (T) which is found in DNA, the tables use uracil (U) which is found in RNA. Table 2 has been adapted so that frequencies are calculated for each amino acid, rather than for all 64 codons.

TABLE 2

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function at http://www.entelechon.com/bioinformatics/backtranslation.php?lang=eng (visited Apr. 15, 2008) and the "backtranseq" function available at http://bioinfo.pbi.nrc.ca:8090/EMBOSS/index.html (visited Jul. 9, 2002). Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (userpages.umbc.edu/~wug1/codon/sgd/, accessed Mar. 19, 2012_).

A polynucleotide or nucleic acid fragment is "hybridizable" to another nucleic acid fragment, such as a cDNA, genomic DNA, or RNA molecule, when a single-stranded form of the nucleic acid fragment can anneal to the other nucleic acid fragment under the appropriate conditions of temperature and solution ionic strength. Hybridization and washing conditions are well known and exemplified in Sambrook, J., Fritsch, E. F. and Maniatis, T. *Molecular Cloning: A Laboratory Manual*, 2$^{nd}$ ed., Cold Spring Harbor Laboratory: Cold Spring Harbor, N.Y. (1989), particularly Chapter 11 and Table 11.1 therein. The conditions of temperature and ionic strength determine the "stringency" of the hybridization. Stringency conditions can be adjusted to screen for moderately similar fragments (such as homologous sequences from distantly related organisms), to highly similar fragments (such as genes that duplicate functional enzymes from closely related organisms). Post-hybridization washes determine stringency conditions. One set of preferred conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. A more preferred set of stringent conditions uses higher temperatures in which the washes are identical to those above except for the temperature of the final two 30 min washes in 0.2×SSC, 0.5% SDS was increased to 60° C. Another preferred set of highly stringent conditions uses two final washes in 0.1×SSC, 0.1% SDS at 65° C. An additional set of stringent conditions include hybridization at 0.1×SSC, 0.1% SDS, 65° C. and washes with 2×SSC, 0.1% SDS followed by 0.1×SSC, 0.1% SDS, for example.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of $T_m$ for hybrids of nucleic acids having those sequences. The relative stability (corresponding to higher $T_m$) of nucleic acid hybridizations decreases in the following order: RNA:RNA, DNA:RNA, DNA:DNA. For hybrids of greater than 100 nucleotides in length, equations for calculating Tm have been derived (see Sambrook et al., supra, 9.50-9.51). For hybridizations with shorter nucleic acids, i.e., oligonucleotides, the position of mismatches becomes more important, and the length of the oligonucleotide determines its specificity (see Sambrook et al., supra, 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least about 30 nucleotides. Furthermore, the skilled artisan will recognize that the temperature and wash solution salt concentration may be adjusted as necessary according to factors such as length of the probe.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as Basic Local Alignment Search Tool ("BLAST"; Altschul, S. F., et al., *J. Mol. Biol.*, 215:403-410 (1993)). In general, a sequence of ten or more contiguous amino acids or thirty or more nucleotides is necessary in order to putatively identify a polypeptide or nucleic acid sequence as homologous to a known protein or gene. Moreover, with respect to nucleotide sequences, gene specific oligonucleotide probes comprising 20-30 contiguous nucleotides may be used in sequence-dependent methods of gene identification (e.g., Southern hybridization) and isolation (e.g., in situ hybridization of bacterial colonies or bacteriophage plaques). In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence. The instant specification teaches the complete amino acid and nucleotide sequence encoding particular proteins. The skilled artisan, having the benefit of the sequences as reported herein, may now use all or a substantial portion of the disclosed sequences for purposes known to those skilled in this art. Accordingly, the instant invention comprises the complete sequences as provided herein, as well as substantial portions of those sequences as defined above.

The term "complementary" is used to describe the relationship between nucleotide bases that are capable of hybridizing to one another. For example, with respect to DNA, adenosine is complementary to thymine and cytosine is complementary to guanine.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those disclosed in: 1.) *Computational Molecular Biology* (Lesk, A. M., Ed.) Oxford University: NY (1988); 2.) *Biocomputing: Informatics and Genome Projects* (Smith, D. W., Ed.) Academic: NY (1993); 3.) *Computer Analysis of Sequence Data, Part I* (Griffin, A. M., and Griffin, H. G., Eds.) Humania: NJ (1994); 4.) *Sequence Analysis in Molecular Biology* (von Heinje, G., Ed.) Academic (1987); and 5.) *Sequence Analysis Primer* (Gribskov, M. and Devereux, J., Eds.) Stockton: NY (1991).

Preferred methods to determine identity are designed to give the best match between the sequences tested. Methods to determine identity and similarity are codified in publicly available computer programs. Sequence alignments and percent identity calculations may be performed using the MegAlign™ program of the LASERGENE bioinformatics computing suite (DNASTAR Inc., Madison, Wis.). Multiple alignment of the sequences is performed using the "Clustal method of alignment" which encompasses several varieties of the algorithm including the "Clustal V method of alignment" corresponding to the alignment method labeled Clustal V (disclosed by Higgins and Sharp, *CABIOS.* 5:151-153 (1989); Higgins, D. G. et al., *Comput. Appl. Biosci.*, 8:189-191 (1992)) and found in the MegAlign™ program of the LASERGENE bioinformatics computing suite (DNASTAR Inc.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, *CABIOS.* 5:151-153 (1989); Higgins, D. G. et al., *Comput. Appl. Biosci.* 8:189-191 (1992)) and found in the MegAlign™ v6.1 program of the LASERGENE bioinformatics computing suite (DNASTAR Inc.). Default parameters for multiple alignment (GAP PENALTY=10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

It is well understood by one skilled in the art that many levels of sequence identity are useful in identifying polypeptides, including variants or polypeptides from other species, wherein such polypeptides have the same or similar function or activity. Useful examples of percent identities include, but are not limited to: 55%, 60%, 65%, 70%, 75%, 80%, 85%, 90%, or 95%, or any integer percentage from 55% to 100% may be useful in describing the present invention, such as 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Suitable nucleic acid fragments not only have the above homologies but typically encode a polypeptide having at least 50 amino acids, preferably at least 100 amino acids, more preferably at least 150 amino acids, still more preferably at least 200 amino acids, and most preferably at least 250 amino acids.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., *J. Mol. Biol.,* 215:403-410 (1990)); 3.) DNASTAR (DNASTAR, Inc. Madison, Wis.); 4.) Sequencher (Gene Codes Corporation, Ann Arbor, Mich.); and 5.) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods used here are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.).

The genetic manipulations of a recombinant host cell disclosed herein can be performed using standard genetic techniques and screening and can be made in any host cell that is suitable to genetic manipulation (*Methods in Yeast Genetics,* 2005, Cold Spring Harbor Laboratory Press, Cold Spring Harbor, N.Y., pp. 201-202). In embodiments, the recombinant host cell is *E. coli*. In embodiments, a recombinant host cell disclosed herein can be any yeast or fungal host useful for genetic modification and recombinant gene expression. In other embodiments, a recombinant host cell can be a member of the genera *Zygosaccharomyces, Schizosaccharomyces, Dekkera, Issatchenkia, Torulopsis, Brettanomyces, Torulaspora, Hanseniaspora, Kluyveromyces*, and some species of *Candida*. In another embodiment, a recombinant host cell can be *Saccharomyces cerevisiae*.

The Applicants have discovered that recombinant host cells which are able to express and secrete lipase enzymes into a fermentation medium produce a catalyst that will catalyze the esterification of alcohol and carboxylic acid. Such host cells represent an improvement to host cells used in fermentative production of alcohols because the esterification of the alcohol may allow the cells to produce alcohol with greater efficiency, or to produce an amount of alcohol in excess of the amount of alcohol that would exert a toxic effect on the host cells. Also, use of such recombinant microorganisms can reduce or eliminate the need to add purified lipase enzyme to a fermentation medium to carry out the processes described herein, which may provide cost and operational advantages.

Furthermore, fermentative production of alcohols typically utilizes a renewable biomass feedstock to supply the carbon substrate which a recombinant microorganism converts to product alcohol. Such feedstocks can contain an amount of triglycerides. When extractive fermentation is practiced to remove the product alcohol from the fermentation, the triglycerides may build up over time, decreasing the partition coefficient and recyclability of the extractant. The lipases secreted by the recombinant host cells provided herein can advantageously hydrolyze the triglycerides into free fatty acids which may be substrates for esterification and which may also have less effect on the partition coefficient of an extractant for product alcohols.

Polypeptides Having Lipase Activity

Recombinant host cells disclosed herein comprise polynucleotides having polypeptides having lipase activity. Examples of lipase polynucleotides and polypeptides and the organisms from which they are derived are provided in Table 3.

TABLE 3

Example lipase polynucleotides and polypeptides

| Species and Accession Number or Reference | Nucleic acid SEQ ID NO: | Amino acid SEQ ID NO: | Nucleic Acid Sequence, Codon-optimized for expression in S. cerevisiae |
|---|---|---|---|
| Candida antarctica Z30645 | 1 | 2 | 7 |
| Candida deformans AJ428393 | 3 | 4 | 8 |
| Thermomyces lanuginosus AF054513 | 5 | 6 | 9 |
| Aspergillus tubingensis lip3 U.S. Pat. No. 7,371,423B2; PCT App. Pub. No. WO98/45453 | 255 | 256 | 257 |

BLAST analysis of the non-redundant protein sequence database at the National Center for Biotechnology Information was performed using, as query sequences, lipases described in Table 3, in order to identify proteins with high (>90%) sequence similarity. Results are shown in Table 4 (information retrieved from the non-redundant protein sequence database online at the National Center for Biotechnology Information on Jan. 22, 2012). While proteins with sequence similarity greater than 90% are considered to be lipases that are predicted to perform similarly to lipases described herein, sequences with similarity as low as ~30% to the query sequences are annotated as lipases and are contemplated for use with the methods and compositions described herein.

TABLE 4

Additional example lipase polypeptides

| Source Organism | GenBank Accession Number | Identity to lipase | Amino acid SEQ ID NO: |
|---|---|---|---|
| Aspergillus kawachii | GAA84811 | 99% to Aspergillus tubingensis | 241 |
| Aspergillus niger | BAL22280 | 98% to Aspergillus tubingensis | 242 |
| Aspergillus niger | XP_001397501 | 93% to Aspergillus tubingensis | 243 |
| Aspergillus niger | ABG73613 | 93% to Aspergillus tubingensis | 244 |
| Aspergillus niger | ABG37906 | 93% to Aspergillus tubingensis | 245 |
| Yarrowia lipolytica | XP_500282 | 92% to Candida deformans | 246 |
| Yarrowia lipolytica | ADL57415 | 91% to Candida deformans | 247 |
| Talaromyces thermophiles | AEE61324 | 90% to Thermomyces lanuginosus | 248 |

In addition to the lipases described above and in Tables 3 and 4, suitable lipase sequences may be derived from any source, including, for example, *Absidia, Achromobacter, Aeromonas, Alcaligenes, Alternaria, Aspergillus, Achromobacter, Aureobasidium, Bacillus, Beauveria, Brochothrix, Candida, Chromobacter, Coprinus, Fusarium, Geotricum, Hansenula, Humicola, Hyphozyma, Lactobacillus, Metarhizium, Mucor, Nectria, Neurospora, Paecilomyces, Penicillium, Pseudomonas, Rhizoctonia, Rhizomucor, Rhizopus, Rhodosporidium, Rhodotorula, Saccharomyces, Sus, Sporobolomyces, Thermomyces, Thiarosporella, Trichoderma, Verticillium*, and/or a strain of *Yarrowia*. In embodiments, the source of the lipase is selected from the group consisting of *Absidia blakesleena, Absidia corymbifera, Achromobacter iophagus, Alcaligenes* sp., *Alternaria brassiciola, Aspergillus flavus, Aspergillus niger, Aspergillus kawachii, Aspergillus tubingensis, Aureobasidium pullulans, Bacillus pumilus, Bacillus strearothermophilus, Bacillus subtilis, Brochothrix thermosohata, Candida cylindracea (Candida rugosa), Candida paralipolytica, Candida antarctica* lipase A, *Candida antarctica* lipase B, *Candida ernobii, Candida deformans, Candida thermophila, Chromobacter viscosum, Coprinus cinerius, Fusarium oxysporum, Fusarium solani, Fusarium solani pisi, Fusarium roseum culmorum, Geotrichum candidum, Geotricum penicillatum, Hansenula anomala, Humicola brevispora, Humicola brevis* var. *thermoidea, Humicola insolens, Lactobacillus curvatus, Rhizopus niveus, Rhizopus oryzae, Penicillium cyclopium, Penicillium crustosum, Penicillium expansum, Penicillium* sp. I, *Penicillium* sp. II, *Pseudomonas aeruginosa, Pseudomonas alcaligenes, Pseudomonas cepacia* (syn. *Burkholderia cepacia*), *Pseudomonas fluorescens, Pseudomonas fragi, Pseudomonas maltophilia, Pseudomonas mendocina, Pseudomonas mephitica lipolytica, Pseudomonas alcaligenes, Pseudomonas plantari, Pseudomonas pseudoalcaligenes, Pseudomonas putida, Pseudomonas stutzeri*, and *Pseudomonas wisconsinensis, Rhizoctonia solani, Rhizomucor miehei, Rhizopus japonicus, Rhizopus microsporus, Rhizopus nodosus, Rhodosporidium toruloides, Rhodotorula glutinis, Saccharomyces cerevisiae, Sporobolomyces shibatanus, Sus scrofa, Talaromyces thermophiles, Thermomyces lanuginosus* (formerly *Humicola lanuginose*), *Thiarosporella phaseolina, Trichoderma harzianum, Trichoderma reesei*, and *Yarrowia lipolytica*. In embodiments, the lipase is selected from the group consisting of *Thermomyces lanuginosus* lipase, *Aspergillus* sp. lipase, *Aspergillus niger* lipase, *Aspergillus tubingensis* lip3, *Candida antarctica* lipase B, *Pseudomonas* sp. lipase, *Penicillium roqueforti* lipase, *Penicillium camembertii* lipase, *Mucor javanicus* lipase, *Burkholderia cepacia* lipase, *Alcaligenes* sp. lipase, *Candida rugosa* lipase, *Candida parapsilosis* lipase, *Candida deformans* lipases, lipases A and B from *Geotrichum candidum, Neurospora crassa* lipase, *Nectria haematococca* lipase, *Fusarium heterosporum* lipase *Rhizopus delemar* lipase, *Rhizomucor miehei* lipase, *Rhizopus arrhizus* lipase, and *Rhizopus oryzae* lipase.

One of skill in the art will appreciate that polynucleotide sequences that encode polypeptides with lipase activity such as the polynucleotide sequences in the table above or derived from the indicated sources can be codon-optimized for the recombinant host cell. Further, one of skill in the art will appreciate that truncations and conservative substitutions can be made to the polypeptide sequences given without eliminating the lipase activity of the polypeptide. Accordingly, provided herein are polypeptides having at least about 75%, at least about 80%, at least about 90%, at least about 95%, at least about 97%, or at least about 99% identity to the sequences provided and active fragments thereof. Also provided are polynucleotides encoding such polypeptides.

For embodiments of the methods and host cells described herein, that the polypeptide having lipase activity may be expressed and secreted by the microorganism such that the lipase has activity in the fermentation medium during the production of a product alcohol. One of skill in the art will appreciate that polypeptides expressed on the surface of a microorganism, such as cell wall proteins which are processed through the secretory pathway, will be considered to be secreted since the activity of a polypeptide expressed on the cell surface can be available external to the cell. Thus, in embodiments, the secreted lipase is expressed on the surface of the microorganism. Surface expression of proteins is known in the art, as is modification of polypeptides to target them for surface expression. (Washida, M., S. Takahashi, M. Ueda and A. Tanaka (2001). "Spacer-mediated display of active lipase on the yeast cell surface." Appl Microbiol Biotechnol 56(5-6): 681-686, Matsumoto, T., H. Fukuda, M. Ueda, A. Tanaka and A. Kondo (2002). "Construction of yeast strains with high cell surface lipase activity by using novel display systems based on the Flo1p flocculation functional domain." Appl Environ Microbiol 68(9): 4517-4522, Mormeneo, M., I. Andres, C. Bofill, P. Diaz and J. Zueco (2008). "Efficient secretion of Bacillus subtilis lipase A in Saccharomyces cerevisiae by translational fusion to the Pir4 cell wall protein." Appl. Microbiol. Biotechnol. 80(3): 437-445, Liu, W., H. Zhao, B. Jia, L. Xu and Y. Yan (2010). "Surface display of active lipase in Saccharomyces cerevisiae using Cwp2 as an anchor protein." Biotechnology Letters 32(2): 255-260, Su, G.-d., X. Zhang and Y. Lin (2010). "Surface display of active lipase in Pichia pastoris using Sed1 as an anchor protein." Biotechnology Letters 32(8): 1131-1136, Kuroda, K. and M. Ueda (2011). "Cell surface engineering of yeast for applications in white biotechnology." Biotechnology Letters 33(1): 1-9). In embodiments, a polypeptide provided herein is fused to a domain of a protein which targets the polypeptide to the cell surface In embodiments, polypeptides provided herein are fused to a domain of Flo1p, Pir4, Sed1, Sag1p, Cwp2, or Aga2. In embodiments, polypeptides provided herein are fused to a protein, or a fragment of a protein, having a GPI anchor motif. GPI anchor motifs are known to those of skill in the art and can be predicted by bioinformatics, for example by using prediction engines (for example, the prediction engine online at mendel.imp.ac.at/gpi/fungi_server.html, accessed Mar. 19, 2012). (Eisenhaber B., et al. "A sensitive predictor for potential GPI lipid modification sites in fungal protein sequences and its application to genome-wide studies for Aspergillus nidulans, Candida albicans, Neurospora crassa, Saccharomyces cerevisiae, and Schizosaccharomyces pombe" J Mol. Biol. 2004 Mar. 19; 337(2):243-53.) Example polypeptide sequence domains which may be used target a polypeptide to the cell surface of Saccharomyces cerevisiae are shown in Table 5. Systematic names of the proteins in Table 5 are according to the Saccharomyces Genome Database ("SGD"; online at www.yeastgenome.org/; information retrieved Mar. 13, 2012). One of skill in the art, equipped with this disclosure, will be able to use the example polypeptide sequences and other such sequences known in the art to construct polypeptides which target lipase activity to the cell surface of a recombinant microorganism.

TABLE 5

Polypeptide sequences of cell surface anchor domains of S. cerevisiae proteins for surface display.

| Protein name | SGD systematic name of protein | Codons of nucleic acid sequence corresponding to protein domain | Amino acid sequence of domain SEQ ID NO: |
|---|---|---|---|
| Sag1 | YJR004C | 331-650 | 249 |
| Aga2 | YGL032C | 1-87† | 250 |
| Flo1 | YAR050W | 1-1099 | 251 |
| Cwp2 | YKL096W | 1-92 | 252 |
| Sed1 | YDR077W | 2-338 | 253 |

†Co-express Aga2 domain with Aga1 (SGD systematic name: YNR044W; SEQ ID NO: 254)

In embodiments, the lipase polypeptide sequences provided herein may be modified such that glycosylation, including, but not limited to, N-glycosylation, reduced or eliminated. Such modification can be carried out by mutating the polynucleotide encoding the polypeptide such that one or more glycosylation motifs is removed. In embodiments, the glycosylation motif is an N-glycosylation motif. In embodiments, the glycosylation motif is NXS/T. In embodiments, the polypeptide having lipase activity does not contain the glycosylation motif NXS/T.

Glycosylation can be reduced or eliminated by any means known in the art. For example, inhibitors of glycosylation such as tunicamycin may be employed or the glycosylation mechanism in a host cell may be altered. Also, glycosylation motifs can be removed by site-directed mutagenesis using techniques known in the art. For example, site-directed mutagenesis can be carried out using commercially available kits (for example, the QuikChange II XL site directed mutagenesis kit, Catalog #200524, Stratagene, La Jolla, Calif.). Site-direct mutagenesis can be carried out by the method of Kunkel, involving incorporation of uracil into the template to be mutated (Kunkel T A (1985) Rapid and efficient site-specific mutagenesis without phenotypic selection. Proc. Natl. Acad. Sci. USA 82:488-492), or by the method of phosphorothioate incorporation (Taylor J W, Ott J, & Eckstein F (1985), The rapid generation of oligonucleotide-directed mutations at high frequency using phosphorothioate-modified DNA. Nucleic Acids Res 13:8765-8785), or by other methods, in vitro and in vivo, known in the art. Primer design for target sites for mutagenesis is well-known in the art, and sequence analysis such as multiple sequence alignment to identify target sites for mutagenesis is likewise well-known.

In embodiments, mutagenesis is carried out such that the N of the motif is substituted with any other naturally occurring amino acid (A, R, D, C, E, Q, G, H, I, L, K, M, F, P, S, T, W, Y, or V; see Table 1). In embodiments, the N of the motif is substituted with A. In embodiments, mutagenesis is carried out such that the S/T of the motif is replaced with any other naturally occurring amino acid (A, R, N, D, C, E, Q, G, H, I, L, K, M, F, P, W, Y, or V; see Table 1). In embodiments, both the N and the S/T are replaced with any other naturally occurring amino acid (A, R, J, D, C, E, Q, G, H, I, L, K, M, F, P, W, Y, or V, or S or T at the N residue; A, R, J, D, C, E, Q, G, H, I, L, K, M, F, P, W, Y, or V, S or N at a T residue; A, R, J, D, C, E, Q, G, H, I, L, K, M, F, P, W, Y, or V, or T or N at an S residue). In embodiments, the glycosylation motif NXS/T is replaced with the motif AXS/T.

In one non-limiting example, C. deformans contains two glycosylation sequences, NIS at codon 146 and NNT at 167. In embodiments, one or both of those glycosylation sites is targeted for substitution and the indicated glycosylation sites are replaced with AIS and ANT, respectively. *C. antarctica* has NDT at 99, and *T. lanuginosus* has NIT at 55. In embodiments, the indicated glycosylation sites are mutated such that the sequences are ADT and AIT at the indicated positions.

Given in Table 6 are predicted glycosylation sites lipase open reading frames from *C. deformans, C. antarctica,* and *T. lanuginosus*, and examples of mutations that abolish those sites. The first column lists the position in the polypeptide at which the glycosylation site occurs. The second column gives the glycosylation sequence at that position, and the DNA sequence encoding it in the codon-optimized polynucleotide. The third column gives the polypeptide sequence at that position after mutagenesis, and the DNA sequence required to effect that amino acid change.

TABLE 6

Predicted glycosylation sites

| Yeast species and glycosylation site position | Native | Modified | SEQ ID NO: of nucleic acid sequence | SEQ ID NO: of amino acid sequence |
|---|---|---|---|---|
| C. deformans 146 | N I S AATATCAGT | A I S GCTATCAGT | 48 | 49 |
| C. deformans 167 | N N T ACAATACAT | A N T GCTATACAT | 50 | 51 |
| C. antarctica 99 | N D T AATGATACT | A D T GCTGATACT | 46 | 47 |
| T. lanuginosus 55 | N I T AACATTACA | A I T GCTATTACA | 54 | 55 |
| A. tubingensis 59 | N L T AACTTAACA | A L T GCTTTAACA | 271 | 272 |
| A. tubingensis 269 | N S T AATTCTACA | A S T GCTTCTACA | 273 | 274 |

In addition, the nucleic acid and amino acid sequences of *Candida deformans* lipase with both of the modifications listed in Table 6 (N146A and N167A) are given as SEQ ID NOs: 52 and 53. The nucleic acid and amino acid sequences of an *A. tubingensis* lipase with both of the modifications listed in Table 6 (N59A and N269A) are given as SEQ ID NOs: 275 and 276.

As shown in the Examples, using techniques known in the art and/or provided herein, one of skill in the art can readily modify glycosylation motifs in lipases and determine the activity of such lipases in methods and compositions provided herein.

One of skill in the art will appreciate that provided herein are polypeptides having at least about 75%, at least about 80%, at least about 90%, at least about 95%, at least about 97%, or at least about 99% identity to the sequences provided and active fragments thereof. Also provided are polynucleotides encoding such polypeptides. One of skill in the art will also appreciate that active variants of the sequences provided herein can be created using techniques known in the art and/or described herein for use in the methods and compositions described herein.

Recombinant Microorganisms and Butanol Biosynthetic Pathways

While not wishing to be bound by theory, it is believed that the improvements and processes described herein may be useful in conjunction with any alcohol producing microorganism, particularly recombinant microorganisms which produce alcohol at titers above their tolerance levels.

Alcohol-producing microorganisms are known in the art. For example, fermentative oxidation of methane by methanotrophic bacteria (for example, *Methylosinus trichosporium*) produces methanol, contacting methanol (a $C_1$ alkyl alcohol) with a carboxylic acid and a catalyst capable of esterifying the carboxylic acid with methanol forms a methanol ester of the carboxylic acid. The wild-type yeast strain CEN.PK113-7D (CBS 8340, the Centraal Buro voor Schimmelculture; van Dijken J P, et al., 2000, An interlaboratory comparison of physiological and genetic properties of four *Saccharomyces cerevisiae* strains. Enzyme Microb. Technol. 26:706-714) can produce ethanol; contacting ethanol with a carboxylic acid and a catalyst capable of esterifying the carboxylic acid with the ethanol forms ethyl ester.

Recombinant microorganisms which produce alcohol are also known in the art (for example, Ohta et al., 1991, Appl. Environ. Microbiol. 57:893-900; Underwood et al., 2002, Appl. Environ. Microbiol. 68:1071-1081; Shen and Liao, 2008, Metab. Eng. 10:312-320; Hahnai et al., 2007,Appl. Environ. Microbiol. 73:7814-7818; U.S. Pat. Nos. 5,514,583, 5,712,133; PCT Application Pub. No. WO1995028476; Feldmann et al., 1992, Appl. Microbiol. Biotechnol. 38: 354-361; Zhang et al., 1995, Science 267:240-243; 20070031918 A1; U.S. Pat. Nos. 7,223,575, 7,741,119; US 20090203099 A1; US Application Pub. No. 2009/0246846 A1; and PCT Application Pub. No. WO2010/075241, which are herein incorporated by reference).

Suitable recombinant microorganisms capable of producing butanol are known in the art, and certain suitable microorganisms capable of producing butanol are described herein. Recombinant microorganisms to produce butanol via a biosynthetic pathway can include a member of the genera *Clostridium, Zymomonas, Escherichia, Salmonella, Serratia, Erwinia, Klebsiella, Shigella, Rhodococcus, Pseudomonas, Bacillus, Lactobacillus, Enterococcus, Alcaligenes, Klebsiella, Paenibacillus, Arthrobacter, Corynebacterium, Brevibacterium, Schizosaccharomyces, Kluyveromyces, Yarrowia, Pichia, Candida, Hansenula, Issatchenkia,* or *Saccharomyces*. In one embodiment, recombinant microorganisms can be selected from the group consisting of *Escherichia coli, Lactobacillus plantarum,* and *Saccharomyces cerevisiae*. In one embodiment, the recombinant microorganism is a yeast. In one embodiment, the recombinant microorganism is crabtree-positive yeast selected from *Saccharomyces, Zygosaccharomyces, Schizosaccharomyces, Dekkera, Torulopsis, Brettanomyces,* and some species of *Candida*. Species of crabtree-positive yeast include, but are not limited to, *Saccharomyces cerevisiae, Saccharomyces kluyveri, Schizosaccharomyces pombe, Saccharomyces bayanus, Saccharomyces mikitae, Saccharomyces paradoxus, Zygosaccharomyces rouxii,* and *Candida glabrata*. In some embodiments, the host cell is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* yeast include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Additionally, recombinant microbial production hosts comprising a 1-butanol biosynthetic pathway (U.S. Patent Application Publication No. US20080182308A1, herein incorporated by reference), a 2-butanol biosynthetic pathway (U.S. Patent Publication Nos. US 20070259410A1, herein incorporated by reference and US 20070292927, herein incorporated by reference), and an isobutanol biosynthetic pathway (U.S. Patent Publication No. US 20070092957, herein incorporated by reference) have been described.

The production of butanol utilizing fermentation with a microorganism, as well as microorganisms which produce butanol, is disclosed, for example, in U.S. Pub. No. 2009/0305370, herein incorporated by reference. In some embodiments, microorganisms comprise a butanol biosynthetic pathway. In embodiments, at least one, at least two, at least three, or at least four polypeptides catalyzing substrate to product conversions of a pathway are encoded by heterologous polynucleotides in the microorganism. In embodiments, all polypeptides catalyzing substrate to product conversions of a pathway are encoded by heterologous polynucleotides in the microorganism. In some embodiments, the microorganism comprises a reduction or elimination of pyruvate decarboxylase activity. Microorganisms substantially free of pyruvate decarboxylase activity are described in US Application Publication No. 20090305363, herein incorporated by reference. Microorganisms substantially free of an enzyme having NAD-dependent glycerol-3-phosphate dehydrogenase activity such as GPD2 are also described therein.

Butanol Biosynthetic Pathways

Certain suitable isobutanol biosynthetic pathways are disclosed in U.S. Patent Application Publication No. US 20070092957, which is incorporated by reference herein. A diagram of the disclosed isobutanol biosynthetic pathways is provided in FIG. 2. As described in U.S. Patent Application Publication No. US 20070092957 A1, which is incorporated by reference herein, steps in an example isobutanol biosynthetic pathway include conversion of:

- pyruvate to acetolactate (see FIG. 2, pathway step a therein), as catalyzed for example by acetolactate synthase,
- acetolactate to 2,3-dihydroxyisovalerate (see FIG. 2, pathway step b therein) as catalyzed for example by KAR1;
- 2,3-dihydroxyisovalerate to 2-ketoisovalerate (see FIG. 2, pathway step c therein) as catalyzed for example by acetohydroxy acid dehydratase, also called dihydroxy-acid dehydratase (DHAD);
- 2-ketoisovalerate to isobutyraldehyde (see FIG. 2, pathway step d therein) as catalyzed for example by branched-chain 2-keto acid decarboxylase; and
- isobutyraldehyde to isobutanol (see FIG. 2, pathway step e therein) as catalyzed for example by branched-chain alcohol dehydrogenase.

The substrate to product conversions for steps f, g, h, i, j, and k of alternative pathways are described in U.S. Patent Application Publication No. US 2007/0092957 A1, which is incorporated by reference herein.

Genes and polypeptides that can be used for the substrate to product conversions described above as well as those for additional isobutanol pathways, are described in U.S. Patent Appl. Pub. No. 20070092957, incorporated by reference herein. US Appl. Pub. Nos. 20070092957 and 20100081154, describe dihydroxyacid dehydratase (DHAD) enzymes, including a DHAD from *Streptococcus mutans* (SEQ ID NO: 262) and a DHAD from *Lactococcus lactis* (SEQ ID NO: 263). U.S. Patent Appl. Publ. No. 2009/0269823 and 2011/0269199 A1, incorporated by reference herein, describe alcohol dehydrogenases, including an alcohol dehydrogenase from *Achromobacter xylosoxidans* (SEQ ID NO: 258) and an alcohol dehydrogenase from *Beijerinkia indica* (SEQ ID NO: 259). Ketol-acid reductoisomerase (KAR1) enzymes are described in U.S. Patent Appl. Pub. Nos. 20080261230 A1, 20090163376, 20100197519, and PCT Appl. Pub. No. WO/2011/041415, all incorporated by reference herein. Keto-acid decarboxylases include those from *Lactococcus lactis* (SEQ ID NO: 260) and *Listeria grayi* (SEQ ID NO: 261)

Additionally described in U.S. Pat. Nos. 7,851,188 and 7,993,889, which is incorporated by reference herein, are construction of chimeric genes and genetic engineering of bacteria and yeast for isobutanol production using the disclosed biosynthetic pathways.

In another embodiment, the isobutanol biosynthetic pathway comprises the following substrate to product conversions:

- pyruvate to acetolactate, which may be catalyzed, for example, by acetolactate synthase;
- acetolactate to 2,3-dihydroxyisovalerate, which may be catalyzed, for example, by ketol-acid reductoisomerase;
- 2,3-dihydroxyisovalerate to α-ketoisovalerate, which may be catalyzed, for example, by dihydroxyacid dehydratase;
- α-ketoisovalerate to valine, which may be catalyzed, for example, by transaminase or valine dehydrogenase;
- valine to isobutylamine, which may be catalyzed, for example, by valine decarboxylase;
- isobutylamine to isobutyraldehyde, which may be catalyzed by, for example, omega transaminase; and,
- isobutyraldehyde to isobutanol, which may be catalyzed, for example, by a branched-chain alcohol dehydrogenase.

In another embodiment, the isobutanol biosynthetic pathway comprises the following substrate to product conversions:

- pyruvate to acetolactate, which may be catalyzed, for example, by acetolactate synthase;
- acetolactate to 2,3-dihydroxyisovalerate, which may be catalyzed, for example, by acetohydroxy acid reductoisomerase;
- 2,3-dihydroxyisovalerate to α-ketoisovalerate, which may be catalyzed, for example, by acetohydroxy acid dehydratase;
- α-ketoisovalerate to isobutyryl-CoA, which may be catalyzed, for example, by branched-chain keto acid dehydrogenase;
- isobutyryl-CoA to isobutyraldehyde, which may be catalyzed, for example, by acetylating aldehyde dehydrogenase; and,
- isobutyraldehyde to isobutanol, which may be catalyzed, for example, by a branched-chain alcohol dehydrogenase.

In another embodiment, the isobutanol biosynthetic pathway comprises the substrate to product conversions shown as steps k, g, and e in FIG. 2.

Biosynthetic pathways for the production of 1-butanol that may be used include those described in U.S. Appl. Pub. No. 2008/0182308, which is incorporated herein by reference. In one embodiment, the 1-butanol biosynthetic pathway comprises the following substrate to product conversions:

a) acetyl-CoA to acetoacetyl-CoA, which may be catalyzed, for example, by acetyl-CoA acetyl transferase;
b) acetoacetyl-CoA to 3-hydroxybutyryl-CoA, which may be catalyzed, for example, by 3-hydroxybutyryl-CoA dehydrogenase;

c) 3-hydroxybutyryl-CoA to crotonyl-CoA, which may be catalyzed, for example, by crotonase;

d) crotonyl-CoA to butyryl-CoA, which may be catalyzed, for example, by butyryl-CoA dehydrogenase;

e) butyryl-CoA to butyraldehyde, which may be catalyzed, for example, by butyraldehyde dehydrogenase; and, f) butyraldehyde to 1-butanol, which may be catalyzed, for example, by butanol dehydrogenase.

Biosynthetic pathways for the production of 2-butanol that may be used include those described in U.S. Appl. Pub. No. 2007/0259410 and U.S. Appl. Pub. No. 2009/0155870, which are incorporated herein by reference. In one embodiment, the 2-butanol biosynthetic pathway comprises the following substrate to product conversions:

a) pyruvate to alpha-acetolactate, which may be catalyzed, for example, by acetolactate synthase;

b) alpha-acetolactate to acetoin, which may be catalyzed, for example, by acetolactate decarboxylase;

c) acetoin to 3-amino-2-butanol, which may be catalyzed, for example, acetonin aminase;

d) 3-amino-2-butanol to 3-amino-2-butanol phosphate, which may be catalyzed, for example, by aminobutanol kinase;

e) 3-amino-2-butanol phosphate to 2-butanone, which may be catalyzed, for example, by aminobutanol phosphate phosphorylase; and, f) 2-butanone to 2-butanol, which may be catalyzed, for example, by butanol dehydrogenase.

In another embodiment, the 2-butanol biosynthetic pathway comprises the following substrate to product conversions:

a) pyruvate to alpha-acetolactate, which may be catalyzed, for example, by acetolactate synthase;

b) alpha-acetolactate to acetoin, which may be catalyzed, for example, by acetolactate decarboxylase;

c) acetoin to 2,3-butanediol, which may be catalyzed, for example, by butanediol dehydrogenase;

d) 2,3-butanediol to 2-butanone, which may be catalyzed, for example, by dial dehydratase; and, e) 2-butanone to 2-butanol, which may be catalyzed, for example, by butanol dehydrogenase.

Methods for in situ Product Removal

The improved microorganisms and processes described herein may be used in conjunction with other in situ product removal processes, such as with those described in PCT Appn. Pub No. WO2011/159998, incorporated by reference herein. FIG. 1 illustrates an example process flow diagram for production of product alcohol such as ethanol or butanol according to an embodiment of the present invention. As shown, a feedstock 12 can be introduced to an inlet in a liquefaction vessel 10 and liquefied to produce a feedstock slurry 16. Feedstock 12 contains hydrolysable polysaccharides that supplies a fermentable carbon substrate (e.g., fermentable sugar such as glucose), and can be a biomass such as, but not limited to rye, wheat, cane or corn, or can otherwise be derived from a biomass. In some embodiments, feedstock 12 can be one or more components of a fractionated biomass, and in other embodiments, feedstock 12 can be a milled, unfractionated biomass. In some embodiments, feedstock 12 can be corn, such as dry milled, unfractionated corn kernels, and the undissolved particles can include germ, fiber, and gluten. The undissolved solids are non-fermentable portions of feedstock 12. For purposes of the discussion herein with reference to the embodiments shown in the Figures, feedstock 12 will often be described as constituting milled, unfractionated corn, in which the undissolved solids have not been separated therefrom. However, it should be understood that the exemplary methods and systems described herein can be modified for different feedstocks whether fractionated or not, as apparent to one of skill in the art.

The process of liquefying feedstock 12 involves hydrolysis of polysaccharides in feedstock 12 into sugars, including for example, dextrins and oligosaccharides. Any known liquefying processes, as well as the corresponding liquefaction vessel, normally utilized by the industry can be used including, but not limited to, the acid process, the acid-enzyme process, or the enzyme process. Such processes can be used alone or in combination. In some embodiments, the enzyme process can be utilized and an appropriate enzyme 14, for example alpha-amylase, is introduced to an inlet in liquefaction vessel 10. Water can also be introduced to liquefaction vessel 10. In embodiments, a saccharification enzyme, for example glucoamylase, may also be introduced to liquefaction vessel 10.

Feedstock slurry 16 produced from liquefying feedstock 12 comprises fermentable carbon substrate (e.g. sugar), and, optionally, depending on the feedstock, triglycerides in the form of oil and undissolved solids derived from the feedstock. Feedstock slurry 16 can be discharged from an outlet of liquefaction vessel 10. In some embodiments, feedstock 12 is corn or corn kernels and therefore feedstock slurry 16 is a corn mash slurry. In some embodiments, feedstock 12 is a lignocellulosic feedstock and therefore feedstock slurry 16 may be a lignocellulosic hydrolysate. In some embodiments, undissolved solids are removed from feedstock slurry 16 prior to introduction into the fermentation vessel.

Feedstock slurry 16 is introduced into a fermentation vessel 30 along with a microorganism comprising a polynucleotide encoding a polypeptide having lipase activity provided in accordance with the present invention 32. Fermentation vessel 30 is configured to ferment slurry 16 to produce alcohol. In particular, microorganism 32 contacts the fermentable carbon substrate in slurry 16 to produce product alcohol. The slurry can include a fermentable carbon source, for example, in the form of oligosaccharides, and water.

In some embodiments, slurry 16 is subjected to a saccharification process in order to break the complex sugars (e.g., oligosaccharides) in slurry 16 into monosaccharides that can be readily metabolized by microorganism 32. Any known saccharification process, normally utilized by the industry can be used including, but not limited to, the acid process, the acid-enzyme process, or the enzyme process. In some embodiments, simultaneous saccharification and fermentation (SSF) can occur inside fermentation vessel 30, as shown in FIG. 1. In some embodiments, an enzyme 38, such as glucoamylase, can be introduced to an inlet in fermentation vessel 30 in order to breakdown the starch or oligosaccharides to glucose capable of being metabolized by microorganism 32.

Carboxylic acid 28 and/or native oil containing triglycerides 26 are introduced into fermentation vessel 30, along with an optional catalyst 42. Optional catalyst 42 can be introduced before, after, or contemporaneously with enzyme 38. Thus, in some embodiments, addition of enzyme 38 and optional catalyst 42 can be stepwise (e.g, catalyst 42, then enzyme 38, or vice versa), or substantially simultaneous (i.e, at exactly the same time as in the time it takes for a person or a machine to perform the addition in one stroke, or one enzyme/catalyst immediately following the other catalyst/enzyme as in the time it takes for a person or a machine to perform the addition in two strokes). Optional catalyst 42 is capable of esterifying the product alcohol with carboxylic acid 28 to form an alcohol ester and in embodiments is a purified lipase. For example, in the case of butanol production, optional catalyst 42 is capable of esterifying butanol with carboxylic acid 28 to form a butanol ester. It is believed that catalyst 42 is optional for use in the methods described herein because the recombinant microorganism will express and display or secrete into the fermentation medium a lipase to catalyze the esterification. However, it may be desirable to add purified lipase (optional catalyst 42) and the methods and microorganisms provided herein allow for a reduction in the amount of optional catalyst 42 to be added.

In the instance that native oil containing triglycerides 26 is supplied to fermentation vessel 30, at least a portion of the acyl glycerides in oil 26 can be hydrolyzed to carboxylic acid 28 by contacting oil 26 with a polypeptide having lipase activity such as secreted or displayed by the microorganisms provided herein and/or optional catalyst 42. In some embodiments, the resulting acid/oil composition includes monoglycerides and/or diglycerides from the partial hydrolysis of the acyl glycerides in the oil. In some embodiments the resulting acid/oil composition includes glycerol, a by-product of acyl glyceride hydrolysis.

In addition, depending on the feedstock, the acyl glycerides in the oil derived from feedstock 12 and present in slurry 16 can also be hydrolyzed to carboxylic acid 28. In some embodiments, the concentration of carboxylic acids in the broth is sufficient to form a two-phase fermentation mixture comprising an organic phase and an aqueous phase.

Carboxylic acid 28 can be any carboxylic acid capable of esterifying with a product alcohol, such as butanol or ethanol, to produce an alcohol ester of the carboxylic acid. For example, in some embodiments, carboxylic acid 28 can be free fatty acid, and in some embodiments the carboxylic acid or free fatty acid have a chain length of 4 to 28 carbons, 4 to 22 carbons in other embodiments, 8 to 22 carbons in other embodiments, 10 to 28 carbons in other embodiments, 10 to 22 carbons in other embodiments, 12 to 22 carbons in other embodiments, 4 to 18 carbons in other embodiments, 12 to 22 carbons in other embodiments, and 12 to 18 carbons in still other embodiments, and 16 to 22 carbons in still other embodiments. In some embodiments, carboxylic acid 28 is one or more of the following fatty acids: azaleic, capric, caprylic, castor, coconut (i.e., as a naturally-occurring combination of fatty acids, including lauric, myrisitic, plamitic, caprylic, capric, stearic, caproic, arachidic, oleic, and linoleic, for example), isostearic, lauric, linseed, myristic, oleic, palm oil, palmitic, palm kernel, pelargonic, ricinoleic, sebacic, soya, stearic acid, tall oil, tallow, and #12 hydroxy stearic. In some embodiments, carboxylic acid 28 is one or more of diacids, e.g., azelaic acid and sebacic acid. In some embodiments, carboxylic acid 28 is one or more saturated, primary carboxylic acids with defined branching of the carbon chain, where said carboxylic acid or mixtures thereof are prepared by the oxidation of 2-alkyl-1-alkanols well known as Guerbet alcohols, where the carboxylic acids have a total number of carbons of from 12 to 22.

Thus, in some embodiments, carboxylic acid 28 can be a mixture of two or more different fatty acids. In some embodiments, carboxylic acid 28 comprises free fatty acid derived from hydrolysis of acyl glycerides by any method known in the art, including chemical or enzymatic hydrolysis. In some embodiments as noted above, carboxylic acid 28 can be derived from native oil 26 by enzymatic hydrolysis of the oil glycerides using an enzyme as catalyst 42. In some embodiments, the fatty acids or mixtures thereof comprise unsaturated fatty acids. The presence of unsaturated fatty acids decreases the melting point, providing advantages for handling. Of the unsaturated fatty acids, those which are monounsaturated, i.e. possessing a single carbon-carbon double bond, may provide advantages with respect to melting point without sacrificing suitable thermal and oxidative stability for process considerations.

In some embodiments, native oil 26 can be tallow, corn, canola, capric/caprylic triglycerides, castor, coconut, cottonseed, fish, jojoba, lard, linseed, neetsfoot, oiticica, palm, peanut, rapeseed, rice, safflower, soya, sunflower, tung, jatropha, pumpkin, palm, grape seed and vegetable oil blends (or oils that can be purified into higher concentrations of different chain length and levels of unsaturation (i.e., 18:1)). In some embodiments, native oil 26 is a mixture of two or more native oils, such as a mixture of palm and soybean oils, for example. In some embodiments, native oil 26 is a plant-derived oil. In some embodiments, the plant-derived oil can be, though not necessarily, derived from biomass that can be used in a fermentation process. The biomass can be the same or different source from which feedstock 12 is obtained. Thus, for example, in some embodiments, oil 26 can be derived from corn, whereas feedstock 12 can be cane. For example, in some embodiments, oil 26 can be derived from corn, and the biomass source of feedstock 12 is also corn. Any possible combination of different biomass sources for oil 26 versus feedstock 12 can be used, as should be apparent to one of skill in the art. In some embodiments, oil 26 is derived from the biomass used in the fermentation process. Thus, in some embodiments oil 26 is derived directly from feedstock 12. For example, when feedstock 12 is corn, then oil 26 is the feedstock's constituent corn oil and may be introduced into fermentation vessel 30 along with slurry 16.

In fermentation vessel 30, alcohol produced by microorganism 32 is esterified with carboxylic acid 28 by the polypeptide having lipase activity secreted by the microorganism (and optionally catalyst 42) to form alcohol esters. For example, in the case of butanol production, butanol produced by microorganism 32 is esterified with carboxylic acid 28 to form butanol esters. In situ product removal (ISPR) can be utilized to remove the alcohol esters from the fermentation broth. Utilizing a recombinant microorganism which expresses and secretes or displays a polypeptide having lipase activity to form esters in conjunction with ISPR can improve the performance of the fermentation. While not wishing to be bound by theory, it is believed that lipase activity in the fermentation medium and esterification of the product alcohol during a fermentation may improve the ability of the microorganism to produce the product alcohol which is particularly desirable for product alcohols that are toxic to the production host cells. Thus, provided herein are methods of improving tolerance of a microorganism to a product alcohol by engineering the microorganism to produce and secrete a polypeptide having lipase activity.

In embodiments, using the microorganism to produce a lipase to form esters in conjunction with ISPR (such as, for example, liquid-liquid extraction) can increase the effective titer by at least about 10%, at least about 20%, at least about 30%, at least about 40%, at least about 50%, at least about 60%, at least about 70%, at least about 80%, at least about 90%, or at least about 100% as compared to the effective titer in an analogous fermentation using ISPR without the microorganism producing a lipase. Similarly, in embodiments, using the microorganism to produce a lipase to form esters in conjunction with ISPR (such as, for example, liquid-liquid extraction) can increase the effective rate by at least about 10%, at least about 20%, at least about 30%, at least about 40%, at least about 50%, at least about 60%, at least about 70%, at least about 80%, at least about 90%, or at least about 100% as compared to the effective rate in an analogous fermentation using ISPR without the microorganism producing a lipase. In embodiments, the effective yield is increased by at least about 10%, at least about 20%, at least about 30%, at least about 40%, or at least about 50%. In some embodiments, the resulting fermentation broth after alcohol esterification can comprise free (i.e., unesterified) alcohol, and in some embodiments, the concentration of free alcohol in the fermentation broth after alcohol esterification is not greater than 1, 3, 6, 10, 15, 20, 25, 30 25, 40, 45, 50, 55, or 60 g/L when the product alcohol is butanol, or, when the product alcohol is ethanol, the concentration of free alcohol in the fermentation broth after alcohol esterification is not greater than 15, 20, 25, 30 25, 40, 45, 50, 55, 60, 65, 70, 75, 80, 85, 90, 95, or 100 g/L. In some embodiments, at least about 20%, at least about 30%, at least about 40%, at least about 50%, at least about 60%, at least about 70%, at least about 80%, or at least about 90% of the effective titer of alcohol is converted to alcohol ester.

In some embodiments, the fermentation broth is contacted during fermentation with an extractant to form a two-phase mixture comprising an aqueous phase and an organic phase. Such liquid-liquid extraction can be performed according to the processes described in U.S. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, $C_{12}$ to $C_{22}$ fatty amides, and mixtures thereof. The extractant may also be an organic extractant selected from the group consisting of saturated, mono-unsaturated, poly-unsaturated (and mixtures thereof) $C_4$ to $C_{22}$ fatty alcohols, $C_4$ to $C_{28}$ fatty acids, esters of $C_4$ to $C_{28}$ fatty acids, $C_4$ to $C_{22}$ fatty aldehydes, and mixtures thereof. Examples of suitable extractants include an extractant comprising at least one solvent selected from the group consisting of oleyl alcohol, behenyl alcohol, cetyl alcohol, lauryl alcohol, myristyl alcohol, stearyl alcohol, oleic acid, lauric acid, myristic acid, stearic acid, methyl myristate, methyl oleate, lauric aldehyde, 1-nonanol, 1-decanol, 1-undecanol, 2-undecanol, 1-nonanal, 2-butyloctanol, 2-butyl-octanoic acid and mixtures thereof. In embodiments, the extractant comprises oleyl alcohol. In embodiments, the extractant comprises a branched chain saturated alcohol, for example, 2-butyloctanol, commercially available as ISOFAL® 12 (Sasol, Houston, Tex.) or Jarcol 1-12 (Jarchem Industries, Inc., Newark, N.J.). In embodiments, the extractant comprises a branched chain carboxylic acid, for example, 2-butyl-octanoic acid, 2-hexyl-decanoic acid, or 2-decyl-tetradecanoic acid, commercially available as ISOCARB® 12, ISOCARB® 16, and ISOCARB® 24, respectively (Sasol, Houston, Tex.). For use with the processes described herein, the extractant(s) for ISPR are typically non-alcohol extractants, so as to avoid consuming carboxylic acid 28 in fermentation vessel 30 by catalytic esterification of carboxylic acid 28 with an alcohol extractant, whereby less carboxylic acid would be available for esterification with the product alcohol. For example, if oleyl alcohol is used as an ISPR extractant, then oleyl alcohol esters of the carboxylic acid may be produced in fermentation vessel due to the presence of lipase activity.

With reference to the embodiment of FIG. 1, the carboxylic acid 28 can also serve as an ISPR extractant 28 or a component thereof. As earlier noted, carboxylic acid 28 can be supplied, and/or formed in situ in the case when native oil 26 is supplied to fermentation vessel 30, and/or formed in situ in the case when feedstock 16 includes triglycerides in the form of oil that can be hydrolyzed. In some embodiments, ISPR extractant 28 includes free fatty acids. In some embodiments, ISPR extractant 28 includes corn oil fatty acids (COFA). In some embodiments, oil 26 is corn oil, whereby ISPR extractant 28 is COFA. ISPR extractant (carboxylic acid) 28 contacts the fermentation broth and forms a two-phase mixture comprising an aqueous phase 34 and an organic phase. The product alcohol ester formed in the fermentation broth preferentially partitions into the organic phase to form an ester-containing organic phase 36. Any free product alcohol in the fermentation broth also preferentially partitions into the ester-containing organic phase. The biphasic mixture can be removed from fermentation vessel 30 as stream 39 and introduced into a vessel 35, in which the ester-containing organic phase 36 is separated from aqueous phase 34. Separation of biphasic mixture 39 into ester-containing organic phase 36 and aqueous phase 34 can be achieved using any methods known in the art, including but not limited to, siphoning, aspiration, decantation, centrifugation, using a gravity settler, membrane-assisted phase splitting, and the like. All or part of aqueous phase 34 can be recycled into fermentation vessel 30 as fermentation medium (as shown), or otherwise discarded and replaced with fresh medium, or treated for the removal of any remaining product alcohol and then recycled to fermentation vessel 30.

With reference to FIG. 1, ester-containing organic phase 36 is introduced into vessel 50 in which the alcohol esters are reacted with one or more substances 52 to recover product alcohol 54. Product alcohol 54 can be recovered using any method known in the art and/or described in PCT Appn. Pub. No. WO2011/159998, incorporated by reference, for obtaining an alcohol from an alcohol ester.

EXAMPLES

As used herein, the meaning of abbreviations used was as follows: "L" means liter(s), "mL" means milliliter(s), "µL" means microliter(s).

General Methods

GC Analysis of Reaction Products in the Aqueous and Extractant Phase

Samples (ca. 5.0 g) were removed from a stirred reaction mixture or fermentation broth containing corn oil fatty acids (COFA) as extractant, and centrifuged to separate aqueous phase and extractant phase. A sample of the resulting aqueous phase or extractant phase (ca. 0.50 g, actual weight recorded) was dissolved in 4.50 mL of a solution of 5.5556 mg/mL of pentadecanoic acid methyl ester (C15:0 FAME, external standard) in isopropanol. The resulting solution was centrifuged to remove any suspended solids, then ca. 1.25 mL of the resulting supernatant was added to a 2.0 mL Agilent GC sample vial and the vial capped with a PTFE septa. Samples were analyzed for isobutanol or fatty acid butyl esters on an Agilent 6890 GC with a 7683B injector and autosampler. The column was an Agilent DB-FFAP column (30 m×0.25 mm ID, 0.25 µm film). The carrier gas was helium at a flow rate of 1.8 mL/min measured at 80° C. with constant head pressure; injector split was 20:1 at 250° C.; oven temperature was 80° C. for 2.0 minutes, 80° C. to 250° C. at 10° C./min, then 250° C. for 20 minutes. Flame ionization detection was used at 250° C. The following GC standards (Nu-Chek Prep; Elysian, Minn.) were used to confirm the identity of fatty acid isobutyl ester products: iso-butyl palmitate, iso-butyl stearate, iso-butyl oleate, iso-butyl linoleate, iso-butyl linolenate, iso-butyl arachidate.

Strain Constructions

TABLE 7

Genotypes of strains used in Examples

| Strain | Genotype |
|---|---|
| PNY827 | MATa/MATα |
| PNY908 | MATa MAL2-8c SUC2 |
| PNY931 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[TEF1(M6)]-LIP|Tlan-CYC1t adh1Δ::UAS(PGK1)P[FBA1]-kivD_Ll(y)-ADH1t |
| PNY932 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::CYC1t-LIP|Tlan-P[TEF1(M6)] adh1Δ::UAS(PGK1)P[FBA1]-kivD_Ll(y)-ADH1t |
| PNY934 | Isogenic with PNY 931, transformed with pBP915 and pYZ090ΔalsS |
| PNY935 | Isogenic with PNY 932, transformed with pBP915 and pYZ090ΔalsS |
| PNY937 | Isogenic with PNY2211, transformed with pBP915 and pYZ090ΔalsS |
| PNY1020 | MATα ura3Δ::loxP his3Δ pTVAN2 |
| PNY1022 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t gpd2Δ::P[TEF1(M4)]-CdLip(y)-CYC1t pBP2092 |
| PNY1023 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t gpd2Δ::P[TEF1(M6)]-CdLip(y)-CYC1t pBP2092 |
| PNY1024 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t gpd2Δ::P[TEF1(M6)]-CaLip(y)-CYC1t pBP2092 |
| PNY1052 | MATa ura3Δ::loxP his3Δ pTVAN31 |
| PNY1053 | MATa ura3Δ::loxP his3Δ pTVAN32 |
| PNY1054 | MATa ura3Δ::loxP his3Δ pTVAN33 |
| PNY1055 | MATa ura3Δ::loxP his3Δ pTVAN9 |
| PNY1056 | MATa ura3Δ::loxP his3Δ pTVAN4 |
| PNY1057 | MATa ura3Δ::loxP his3Δ pTVAN10 |
| PNY1500 | MATa ura3Δ::loxP his3Δ |
| PNY1556 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t |
| PNY2211 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t |
| PNY2242 | MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Ll(y)-ADH1t yprcΔ15Δ::P[PDC5]-ADH|adh_HI-ADH1t ymr226cΔ ald6Δ::loxP |

TABLE 8

Feature information for constructs used in Examples

| Feature | Position | Strand (W = "Watson"; C = "Crick") |
|---|---|---|
| Feature information for SEQ ID NO: 183 | | |
| Amp$^R$ | 1629-2486 | C |
| HIS3 | 4532-5191 | W |
| pTEF1(M6) | 1-400 | C |
| Tlan lipase ORF | 6433-7308 | C |
| CYC1 Terminator | 6175-6424 | C |
| Feature information for SEQ ID NO: 184 | | |
| Amp$^R$ | 1629-2486 | C |
| HIS3 | 4532-5191 | W |
| pTEF1(M6) | 1-400 | C |
| Tlan lipase ORF | 6433-7308 | C |
| CYC1 Terminator | 6175-6424 | C |
| N55A mutation | 7144-7146 | C |
| Feature information for SEQ ID NO: 185 | | |
| Amp$^R$ | 4000-4860 | C |
| Fragment A | 431-931 | W |
| Fragment B | 956-1455 | W |
| 5' URA3 | 1464-1713 | W |
| URA3 | 1714-2517 | W |
| 3' URA3 | 2518-2667 | W |
| Fragment C | 2676-2788 | W |
| Feature information for SEQ ID NO: 186 | | |
| Amp$^R$ | 3059-3919 | C |
| Fragment A | 4550-5050 | W |
| pTEF1(M6) | 5067-5466 | W |
| Tlan lipase ORF | 5476-6350 | W |
| CYC1 Terminator | 6360-6609 | W |
| Fragment B | 15-514 | W |
| 5' URA3 | 523-772 | W |
| URA3 | 773-1576 | W |
| 3' URA3 | 1577-1726 | W |
| Fragment C | 1735-1847 | W |
| Feature information for SEQ ID NO: 187 | | |
| Amp$^R$ | 3059-3919 | C |
| Fragment A | 4550-5050 | W |
| CYC1 Terminator | 5067-5316 | C |
| Tlan lipase ORF | 5326-6200 | C |
| pTEF1(M6) | 6210-6609 | C |
| Fragment B | 15-514 | W |
| 5' URA3 | 523-772 | W |
| URA3 | 773-1576 | W |
| 3' URA3 | 1577-1726 | W |
| Fragment C | 1735-1847 | W |
| Feature information for SEQ ID NO: 188 | | |
| Amp$^R$ | 4610-5470 | C |
| Fragment A | 6101-6601 | W |
| pTEF1(M6) | 7-406 | W |
| Tlan lipase N55A ORF | 416-1290 | W |
| CYC1 Terminator | 1300-1549 | W |
| Fragment B | 1566-2065 | W |
| 5' URA3 | 2074-2323 | W |
| URA3 | 2324-3127 | W |
| 3' URA3 | 3128-3277 | W |
| Fragment C | 3286-3398 | W |

Construction of PNY1500

The strain BP857 ("PNY1500") was derived from CEN.PK 113-7D (CBS 8340; Centraalbureau voor Schimmelcultures (CBS) Fungal Biodiversity Centre, Netherlands) and contains deletions of the following genes: URA3, HIS3.

URA3 Deletion

To delete the endogenous URA3 coding region, a ura3::loxP-kanMX-loxP cassette was PCR-amplified from pLA54 template DNA (SEQ ID NO: 25). pLA54 contains the *K. lactis* TEF1 promoter and kanMX marker, and is flanked by loxP sites to allow recombination with Cre recombinase and removal of the marker. PCR was done using Phusion DNA polymerase (New England BioLabs; Ipswich, Mass.) and primers BK505 and BK506 (SEQ ID NOs:26 and 27). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 µg/ml) at 30° C. Transformants were screened to verify correct integration by PCR using primers LA468 and LA492 (SEQ ID NOs:28 and 29) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 30) and primer oBP453 (SEQ ID NO: 31), containing a 5' tail with homology to the 5' end of HIS3 Fragment B. HIS3 Fragment B was amplified with primer oBP454 (SEQ ID NO: 32), containing a 5' tail with homology to the 3' end of HIS3 Fragment A, and primer oBP455 (SEQ ID NO: 33), containing a 5' tail with homology to the 5' end of HIS3 Fragment U. HIS3 Fragment U was amplified with primer oBP456 (SEQ ID NO: 34), containing a 5' tail with homology to the 3' end of HIS3 Fragment B, and primer oBP457 (SEQ ID NO: 35), containing a 5' tail with homology to the 5' end of HIS3 Fragment C. HIS3 Fragment C was amplified with primer oBP458 (SEQ ID NO: 36), containing a 5' tail with homology to the 3' end of HIS3 Fragment U, and primer oBP459 (SEQ ID NO: 37). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 30) and oBP455 (SEQ ID NO: 33). HIS3 Fragment UC was created by overlapping PCR by mixing HIS3 Fragment U and HIS3 Fragment C and amplifying with primers oBP456 (SEQ ID NO: 34) and oBP459 (SEQ ID NO: 37). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 30) and oBP459 (SEQ ID NO: 37). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO: 38) and oBP461 (SEQ ID NO: 39) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 40) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoroorotic acid (0.1%) at 30° C. to select for isolates that lost the URA3 marker. 5-FOA resistant isolates were grown in and plated on YPD for removal of the pRS423::PGAL1-cre plasmid. Isolates were checked for loss of the KanMX marker, URA3 marker, and pRS423::PGAL1-cre plasmid by assaying growth on YPD-FG418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO: 41) and oBP451 (SEQ ID NO: 42) for Δura3 and primers oBP460 (SEQ ID NO: 38) and oBP461 (SEQ ID NO: 39) for Δhis3 using genomic DNA prepared with a Gentra Puregene Yeast/Bact kit (Qiagen).

Construction of Strain PNY2205

PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO: 18) and primer oBP441 (SEQ ID NO: 19), containing a 5' tail with homology to the 5' end of PDC6 Fragment B. PDC6 Fragment B was amplified with primer oBP442 (SEQ ID NO: 20), containing a 5' tail with homology to the 3" end of PDC6 Fragment A, and primer oBP443 (SEQ ID NO: 21), containing a 5' tail with homology to the 5' end of PDC6 Fragment U. PDC6 Fragment U was amplified with primer oBP444 (SEQ ID NO: 22), containing a 5' tail with homology to the 3' end of PDC6 Fragment B, and primer oBP445 (SEQ ID NO: 23), containing a 5' tail with homology to the 5' end of PDC6 Fragment C. PDC6 Fragment C was amplified with primer oBP446 (SEQ ID NO: 24), containing a 5' tail with homology to the 3' end of PDC6 Fragment U, and primer oBP447 (SEQ ID NO: 56). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO:18) and oBP443 (SEQ ID NO: 21). PDC6 Fragment UC was created by overlapping PCR by mixing PDC6 Fragment U and PDC6 Fragment C and amplifying with primers oBP444 (SEQ ID NO: 22) and oBP447 (SEQ ID NO: 56. The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO: 18) and oBP447 (SEQ ID NO: 56). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO: 57) and oBP449 (SEQ ID NO: 58) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 57) and oBP449 (SEQ ID NO: 58) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO: 59) and oBP555 (SEQ ID NO: 60). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from *Streptococcus mutans* ATCC #700610. The A fragment followed by the ilvD coding region from *Streptococcus mutans* for the PCR cassette for the PDC1 deletion-ilvDSm integration was amplified using Phusion High Fidelity PCR Master Mix (New England BioLabs) and NYLA83 genomic DNA as template, prepared with a Gentra Puregene Yeast/Bact kit (Qiagen). NYLA83 is a strain (construction described in U.S. App. Pub. NO. 20110124060, incorporated herein by reference in its entirety) which carries the PDC1 deletion-ilvDSm integration described in U.S. Patent Application Publication No. 2009/0305363 (herein incorporated by reference in its entirety). PDC1 Fragment A-ilvDSm was amplified with primer oBP513 (SEQ ID NO: 61) and primer oBP515 (SEQ ID NO: 62), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO: 63) containing a 5' tail with homology to the 3' end of PDC1 Fragment A-ilvDSm, and primer oBP517 (SEQ ID NO: 64), containing a 5' tail with homology to the 5' end of PDC1 Fragment U. PDC1 Fragment U was amplified with primer oBP518 (SEQ ID NO: 65), containing a 5' tail with homology to the 3' end of PDC1 Fragment B, and primer oBP519 (SEQ ID NO: 66), containing a 5' tail with homology to the 5' end of PDC1 Fragment C. PDC1 Fragment C was amplified with primer oBP520 (SEQ ID NO: 67), containing a 5' tail with homology to the 3' end of PDC1 Fragment U, and primer oBP521 (SEQ ID NO: 68). PCR products were purified with a PCR Purification kit (Qiagen). PDC1 Fragment A-ilvDSm-B was created by overlapping PCR by mixing PDC1 Fragment A-ilvDSm (SEQ ID NO: 171) and PDC1 Fragment B and amplifying with primers oBP513 (SEQ ID NO: 61) and oBP517 (SEQ ID NO: 64). PDC1 Fragment UC was created by overlapping PCR by mixing PDC1 Fragment U and PDC1 Fragment C and amplifying with primers oBP518 (SEQ ID NO: 65) and oBP521 (SEQ ID NO: 68). The resulting PCR products were purified on an agarose gel followed by a Gel Extraction kit (Qiagen). The PDC1 A-ilvDSm-BUC cassette (SEQ ID NO: 172) was created by overlapping PCR by mixing PDC1 Fragment A-ilvDSm-B and PDC1 Fragment UC and amplifying with primers oBP513 (SEQ ID NO: 61) and oBP521 (SEQ ID NO: 68). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30° C. Transformants with a pdc1 knockout ilvDSm integration were screened for by PCR with primers oBP511 (SEQ ID NO: 69) and oBP512 (SEQ ID NO: 70) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO: 71) and oBP551 (SEQ ID NO: 72). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO: 69) and oBP512 (SEQ ID NO: 70) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter xylosoxidans* (the sadB gene is described in U.S. Patent Appl. No. 2009/0269823, which is herein incorporated by reference in its entirety). A segment of the PCR cassette for the PDC5 deletion-sadB integration was first cloned into plasmid pUC19-URA3MCS. pUC19-URA3MCS is pUC19 (SEQ ID NO: 94) based and contains the sequence of the URA3 gene from *S. cerevisiae* situated within a multiple cloning site (MCS). pUC19 contains the pMB1 replicon and a gene coding for beta-lactamase for replication and selection in *E. coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccharomyces cerevisiae* CEN.PK 113-7D genomic DNA was amplified with primers oBP438 (SEQ ID NO: 89), containing BamHI, AscI, PmeI, and FseI restriction sites, and oBP439 (SEQ ID NO: 90), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 were ligated with T4 DNA ligase after digestion with BamHI and XbaI to create vector pUC19-URA3MCS. The vector was confirmed by PCR and sequencing with primers oBP264 (SEQ ID NO: 91) and oBP265 (SEQ ID NO: 92).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO: 93) as template with primer oBP530 (SEQ ID NO: 73), containing an AscI restriction site, and primer oBP531 (SEQ ID NO: 74), containing a 5' tail with homology to the 5' end of PDC5 Fragment B. PDC5 Fragment B was amplified with primer oBP532 (SEQ ID NO: 75), containing a 5' tail with homology to the 3' end of sadB, and primer oBP533 (SEQ ID NO: 76), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO: 73) and oBP533 (SEQ ID NO: 76). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO: 77) and oBP546 (SEQ ID NO: 78), containing a 5' tail with homology to the 5' end of PDC5 Fragment C. PDC5 Fragment C was amplified with primer oBP547 (SEQ ID NO: 79) containing a 5' tail with homology to the 3' end of PDC5 sadB-Fragment B-Fragment U, and primer oBP539 (SEQ ID NO: 80). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO: 77) and oBP539 (SEQ ID NO: 80). The resulting PCR product was purified on an agarose gel followed by a Gel Extraction kit (Qiagen). The PDC5 A-sadB-BUC cassette (SEQ ID NO: 173) was created by amplifying PDC5 sadB-Fragment B-Fragment U-Fragment C with primers oBP542 (SEQ ID NO: 81), containing a 5' tail with homology to the 50 nucleotides immediately upstream of the native PDC5 coding sequence, and oBP539 (SEQ ID NO: 80). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30° C. Transformants with a pdc5 knockout sadB integration were screened for by PCR with primers oBP540 (SEQ ID NO: 82) and oBP541 (SEQ ID NO: 83) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO: 84) and oBP553 (SEQ ID NO: 85). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of sad B, and marker removal were confirmed by PCR with primers oBP540 (SEQ ID NO: 82) and oBP541 (SEQ ID NO: 83) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO: 174) was PCR-amplified using loxP-URA3-loxP PCR as template DNA. loxP-URA3-loxP (SEQ ID NO: 170) contains the URA3 marker from pRS426 flanked by loxP recombinase sites. PCR was done using Phusion DNA polymerase and primers LA512 (SEQ ID NO: 95) and LA513 (SEQ ID NO: 96). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 (SEQ ID NO: 86) and AA270 (SEQ ID NO: 87).

The URA3 marker was recycled by transformation with pRS423::PGAL1-cre and plating on synthetic complete media lacking histidine supplemented with 1% ethanol at 30° C. Transformants were streaked on synthetic complete medium supplemented with 1% ethanol and containing 5-fluoro-orotic acid (0.1%) and incubated at 30° C. to select for isolates that had lost the URA3 marker. 5-FOA resistant isolates were grown in YPE (1% ethanol) for removal of the pRS423::PGAL1-cre plasmid. The deletion and marker removal were confirmed by PCR with primers oBP582 (SEQ ID NO: 86) and oBP591 (SEQ ID NO: 88). The correct isolate was selected as strain CEN.PK 113-7D Δura3::loxP Δhis3 Δpdc6 Δpdc1::ilvDSm Δpdc5::sadB Agpd2::loxP and designated as BP1064 (PNY1503).

FRA2 Deletion

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs) and CEN.PK 113-7D genomic DNA as template, prepared with a Gentra Puregene Yeast/Bact kit (Qiagen). FRA2 Fragment A was amplified with primer oBP594 (SEQ ID NO: 99) and primer oBP595 (SEQ ID NO: 102), containing a 5' tail with homology to the 5' end of FRA2 Fragment B. FRA2 Fragment B was amplified with primer oBP596 (SEQ ID NO: 103), containing a 5' tail with homology to the 3' end of FRA2 Fragment A, and primer oBP597 (SEQ ID NO: 104), containing a 5' tail with homology to the 5' end of FRA2 Fragment U. FRA2 Fragment U was amplified with primer oBP598 (SEQ ID NO: 105), containing a 5' tail with homology to the 3' end of FRA2 Fragment B, and primer oBP599 (SEQ ID NO: 106) containing a 5' tail with homology to the 5' end of FRA2 Fragment C. FRA2 Fragment C was amplified with primer oBP600 (SEQ ID NO: 107), containing a 5' tail with homology to the 3' end of FRA2 Fragment U, and primer oBP601 (SEQ ID NO: 108). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 99) and oBP597 (SEQ ID NO: 104). FRA2 Fragment UC was created by overlapping PCR by mixing FRA2 Fragment U and FRA2 Fragment C and amplifying with primers oBP598 (SEQ ID NO: 105) and oBP601 (SEQ ID NO: 108). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 99) and oBP601 (SEQ ID NO: 108). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research). Transformation mixtures were plated on synthetic complete media lacking uracil supplemented with 1% ethanol at 30° C. Transformants with a fra2 knockout were screened for by PCR with primers oBP602 (SEQ ID NO: 109) and oBP603 (SEQ ID NO: 110) using genomic DNA prepared with a Gentra Puregene Yeast/Bact kit (Qiagen). A correct transformant was grown in YPE (yeast extract, peptone, 1% ethanol) and plated on synthetic complete medium containing 5-fluoro-orotic acid (0.1%) at 30° C. to select for isolates that lost the URA3 marker. The deletion and marker removal were confirmed by PCR with primers oBP602 (SEQ ID NO: 109) and oBP603 (SEQ ID NO: 110) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO: 111) and oBP606 (SEQ ID NO: 112). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135).

ADH1 Deletion and kivD_Ll(y) Integration

The ADH1 gene was deleted and replaced with the kivD coding region from *Lactococcus lactis* codon optimized for expression in *S. cerevisiae*. The scarless cassette for the ADH1 deletion-kivD_Ll(y) integration was first cloned into plasmid pUC19-URA3MCS.

The kivD coding region from *Lactococcus lactis* codon optimized for expression in *S. cerevisiae* was amplified using pLH468 (SEQ ID NO: 129) as template with primer oBP562 (SEQ ID NO: 113), containing a PmeI restriction site, and primer oBP563 (SEQ ID NO: 114), containing a 5' tail with homology to the 5' end of ADH1 Fragment B. ADH1 Fragment B was amplified from genomic DNA prepared as above with primer oBP564 (SEQ ID NO: 115), containing a 5' tail with homology to the 3' end of kivD_Ll(y), and primer oBP565 (SEQ ID NO: 116), containing a FseI restriction site. PCR products were purified with a PCR Purification kit (Qiagen). kivD_Ll(y)-ADH1 Fragment B was created by overlapping PCR by mixing the kivD_Ll(y) and ADH1 Fragment B PCR products and amplifying with primers oBP562 (SEQ ID NO: 113) and oBP565 (SEQ ID NO: 116). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 117), containing a SacI restriction site, and primer oBP506 (SEQ ID NO: 118), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO: 119), containing a PacI restriction site, and primer oBP508 (SEQ ID NO: 120), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-$P_{FBA1}$ was amplified from vector pRS316-UAS(PGK1)-$P_{FBA1}$-GUS (SEQ ID NO: 130) with primer oBP674 (SEQ ID NO: 121), containing an AscI restriction site, and primer oBP675 (SEQ ID NO: 122), containing a PmeI restriction site. The UAS(PGK1)-$P_{FBA1}$ PCR product was digested with AscI and PmeI and ligated with T4 DNA ligase into the corresponding sites of the plasmid containing kivD_Ll(y)-ADH1 Fragments ABC. The entire integration cassette was amplified from the resulting plasmid with primers oBP505 (SEQ ID NO: 117) and oBP508 (SEQ ID NO: 120) and purified with a PCR Purification kit (Qiagen).

Competent cells of PNY1505 were made and transformed with the ADH1-kivD_Ll(y) PCR cassette constructed above using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium containing 5-fluoro-orotic acid (0.1%) at 30° C. to select for isolates that lost the URA3 marker. The deletion of ADH1 and integration of kivD_Ll(y) were confirmed by PCR with external primers oBP495 (SEQ ID NO: 123) and oBP496 (SEQ ID NO: 124) and with kivD_Ll(y) specific primer oBP562 (SEQ ID NO: 113) and external primer oBP496 (SEQ ID NO: 124) using genomic DNA prepared with a Gentra Puregene Yeast/Bact kit (Qiagen). The correct isolate was selected as strain CEN.PK 113-7D MATa ura3Δ::loxP his3E pdc6Δ pdc1Δ::P[PDC1]-DHAD|ilvD_Sm-PDC1tpdc5Δ::P[PDC5]-ADH|sadB_Ax-PDC5t gpd2Δ::loxP fra2Δ adh1Δ::UAS(PGK1)P[FBA1]-kivD_Ll(y)-ADH1t and designated as PNY1507 (BP1201).

Construction of Integration Vector pUC19-kan::pdc1::FBA-alsS::TRX1

The FBA-alsS-CYCt cassette was constructed by moving the 1.7 kb BbvCI/PacI fragment from pRS426::GPD::alsS::CYC (described in U.S. Pat. No. 7,851,188, which is herein incorporated by reference in its entirety) to pRS426::FBΔ::ILV5::CYC (described in U.S. Pat. No. 7,851,188, which is herein incorporated by reference in its entirety), which had been previously digested with BbvCI/PacI to release the ILV5 gene. Ligation reactions were transformed into *E. coli* TOP10 cells and transformants were screened by PCR using primers N98SeqF1 (SEQ ID NO: 125) and N99SeqR2 (SEQ ID NO: 126). The FBA-alsS-CYCt cassette was isolated from the vector using BglII and NotI for cloning into pUC19-URA3::ilvD-TRX1 at the AflII site (Klenow fragment was used to make ends compatible for ligation). Transformants containing the alsS cassette in both orientations in the vector were obtained and confirmed by PCR using primers N98SeqF4 (SEQ ID NO: 127) and N1111 (SEQ ID NO: 128) for configuration "A" and N98SeqF4 (SEQ ID NO: 127) and N1110 (SEQ ID NO: 153) for configuration "B". A geneticin-selectable version of the "A" configuration vector was then made by removing the URA3 gene (1.2 kb NotI/NaeI fragment) and adding a geneticin cassette. Klenow fragment was used to make all ends compatible for ligation, and transformants were screened by PCR to select a clone with the geneticin resistance gene in the same orientation as the previous URA3 marker using primers BK468 (SEQ ID NO: 131) and N160SeqF5 (SEQ ID NO: 154). The resulting clone was called pUC19-kan::pdc1::FBA-alsS::TRX1 (clone A) (SEQ ID NO: 155).

Construction of alsS Integrant Strains

The pUC19-kan::pdc1::FBA-alsS integration vector described above was linearized with PmeI and transformed into PNY1507. PmeI cuts the vector within the cloned pdc1-TRX1 intergenic region and thus leads to targeted integration at that location (Rodney Rothstein, Methods in Enzymology, 1991, volume 194, pp. 281-301). Transformants were selected on YPE plus 50 μg/ml G418. Patched transformants were screened by PCR for the integration event using primers N160SeqF5 (SEQ ID NO: 154) and oBP512 (SEQ ID NO: 70). Two transformants were tested indirectly for acetolactate synthase function by evaluating the strains' ability to make isobutanol. To do this, additional isobutanol pathway genes were supplied on *E. coli*-yeast shuttle vectors (pYZ090ΔalsS and pBP915; SEQ ID NOs: 43 and 44, respectively). One clone was designated as PNY2205. The plasmid-free parent strain was designated PNY2204 (MATa ura3Δ::loxP his3Δ pdc6Δ pdc1Δ::P[PDC1]-DHAD|ilvD_Sm-PDC1t-pUC19-loxP-kanMX-loxP-P[FBA1]-ALS|alsS_Bs-CYC1t pdc5Δ::

P[PDC5]-ADH|sadB_Ax-PDC5t gpd2Δ::loxP fra2Δ adh1Δ::UAS(PGK1)P[FBA1]-kivD_Ll(y)-ADH1t).

Construction of Strain PNY2211

PNY2211 was constructed in several steps from *S. cerevisiae* strain PNY1507 as described in the following paragraphs. First the strain was modified to contain a phosphoketolase gene. Next, an acetolactate synthase gene (alsS) was added to the strain, using an integration vector targeted to sequence adjacent to the phosphoketolase gene. Finally, homologous recombination was used to remove the phosphoketolase gene and integration vector sequences, resulting in a scarless insertion of alsS in the intergenic region between pdc1Δ::ilvD and the native TRX1 gene of chromosome XII. The resulting genotype of PNY2211 is MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS (PGK1)P[FBA1]-kivD_Ll(y)-ADH1t.

A phosphoketolase gene cassette was introduced into PNY1507 bp homologous recombination. The integration construct was generated as follows. The plasmid pRS423::CUP1-alsS+FBA-budA (previously described in US2009/0305363, which is herein incorporated by reference in its entirety) was digested with NotI and XmaI to remove the 1.8 kb FBA-budA sequence, and the vector was religated after treatment with Klenow fragment. Next, the CUP1 promoter was replaced with a TEF1 promoter variant (M4 variant previously described by Nevoigt et al. *Appl. Environ. Microbiol.* 72: 5266-5273 (2006), which is herein incorporated by reference in its entirety) via DNA synthesis and vector construction service from DNA2.0 (Menlo Park, Calif.). The resulting plasmid, pRS423::TEF(M4)-alsS was cut with StuO and MluI (removes 1.6 kb portion containing part of the alsS gene and CYC1 termintor), combined with the 4 kb PCR product generated from pRS426::GPD-xpk1+ADH-eutD (SEQ ID NO: 175) with primers N1176 (SEQ ID NO: 164) and N1177 (SEQ ID NO: 165) and an 0.8 kb PCR product DNA generated from yeast genomic DNA (ENO1 promoter region) with primers N822 (SEQ ID NO: 160) and N1178 (SEQ ID NO: 166) and transformed into *S. cerevisiae* strain BY4741 (ATCC #201388) using gap repair cloning methodology, see Ma et al. Gene 58:201-216 (1987). Transformants were obtained by plating cells on synthetic complete medium without histidine. Proper assembly of the expected plasmid (pRS423::TEF1(M4)-xpk1+ENO1-eutD, SEQ ID NO: 156) was confirmed by PCR primers N821 and N1115 (SEQ ID NOs: 159 and 163, respectively) and by restriction digest (BglI). Two clones were subsequently sequenced. The 3.1 kb TEF(M4)-xpk1 gene was isolated by digestion with SacI and NotI and cloned into the pUC19-URA3::ilvD-TRX1 vector (Clone A, cut with AflII). Cloning fragments were treated with Klenow fragment to generate blunt ends for ligation. Ligation reactions were transformed into *E. coli* Stb13 cells, selecting for ampicillin resistance. Insertion of TEF1(M4)-xpk1 was confirmed by PCR (primers N1110 (SEQ ID NO: 153) and N1114 (SEQ ID NO: 162)). The vector was linearized with AflII and treated with Klenow fragment. The 1.8 kb KpnI-HincII geneticin resistance cassette described in WO2011159853A1 (incorporated herein by reference) was cloned by ligation after Klenow fragment treatment. Ligation reactions were transformed into *E. coli* Stbl3 cells, selecting for ampicillin resistance. Insertion of the geneticin cassette was confirmed by PCR (primers N160SeqF5 (SEQ ID NO: 154) and BK468 (SEQ ID NO: 131)). The plasmid sequence is provided herein (pUC19-URA3::pdc1::TEF(M4)-xpk1::kan, SEQ ID NO: 157).

The resulting integration cassette (pdc1::TEF1(M4)-xpk1::KanMX::TRX1) was isolated (AscI and NaeI digestion generated a 5.3 kb band that was gel purified) and transformed into PNY1507 using the Zymo Research Frozen-EZ Yeast Transformation Kit (Cat. No. T2001). Transformants were selected by plating on YPE plus 50 μg/ml G418. Integration at the expected locus was confirmed by PCR (primers N886 and N1214, SEQ ID NOs: 161 and 167, respectively). Next, plasmid pRS423::GAL1p-Cre (SEQ ID NO: 169), encoding Cre recombinase, was used to remove the loxP-flanked KanMX cassette. Proper removal of the cassette was confirmed by PCR (primers oBP512 and N160SeqF5 (SEQ ID NOs: 168 and 154, respectively)). Finally, the alsS integration plasmid described herein (SEQ ID NO: 155; pUC19-kan::pdc1::FBA-alsS::TRX1, clone A) was transformed into this strain using the included geneticin selection marker. Two integrants were tested for acetolactate synthase activity by transformation with plasmids pYZ090ΔalsS (SEQ ID NO: 43) and pBP915 (SEQ ID NO: 44) transformed using Protocol #2 in Amberg, Burke and Strathern "Methods in Yeast Genetics" (2005), and evaluation of growth and isobutanol production in glucose-containing media (methods for growth and isobutanol measurement are as follows: All strains were grown in synthetic complete medium, minus histidine and uracil containing 0.3% glucose and 0.3% ethanol as carbon sources (10 mL medium in 125 mL vented Erlenmeyer flasks (VWR Cat. No. 89095-260). After overnight incubation (30° C., 250 rpm in an Innova®40 New Brunswick Scientific Shaker), cultures were diluted back to 0.2 OD (Eppendorf BioPhotometer measurement) in synthetic complete medium containing 2% glucose and 0.05% ethanol (20 ml medium in 125 mL tightly-capped Erlenmeyer flasks (VWR Cat. No. 89095-260)). After 48 hours incubation (30° C., 250 rpm in an Innova®40 New Brunswick Scientific Shaker), culture supernatants (collected using Spin-X centrifuge tube filter units, Costar Cat. No. 8169) were analyzed by HPLC per methods described in U.S. Appl. Pub. No. 20070092957). One of the two clones was positive and was named PNY2218.

PNY2218 was treated with Cre recombinase, and the resulting clones were screened for loss of the xpk1 gene and pUC19 integration vector sequences by PCR (primers N886 and N160SeqR5; SEQ ID NOs: 161 and 158, respectively). This left only the alsS gene integrated in the pdc1-TRX1 intergenic region after recombination the DNA upstream of xpk1 and the homologous DNA introduced during insertion of the integration vector (a "scarless" insertion since vector, marker gene and loxP sequences are lost). Although this recombination could have occurred at any point, the vector integration appeared to be stable even without geneticin selection, and the recombination event was only observed after introduction of the Cre recombinase. One clone was designated PNY2211.

Construction of *Saccharomyces cerevisiae* Strain PNY2242

Strain PNY2242 was constructed in several steps from PNY1507 (described above). First, a chimeric gene comprised of the FBA1 promoter, the alsS coding region and the CYC1 terminator was integrated into Chromosome XII, upstream of the TRX1 gene. The sequence of the modified locus is provided as SEQ ID No. 176. Next, two copies of a gene encoding horse liver alcohol dehydrogenase were integrated into Chromsomes VII and XVI. On Chromosome VII, a chimeric gene comprised of the PDC1 promoter, the hADH coding region and the ADH1 terminator were placed into the fra2Δ locus (the original deletion of FRA2 is described above). The sequence of the modified locus is provided as SEQ ID No. 177. On Chromosome XVI, a chimeric gene comprised of the PDC5 promoter, the hADH coding region and the ADH1 terminator were integrated in the region formerly occupied by the long term repeat element YPRCdelta15. The sequence of the modified locus is provided as SEQ ID No. 178. Then the native genes YMR226c and ALD6 were deleted. Elimination of YMR226c was a scarless deletion of only the coding region. The sequence of the modified locus is provided as SEQ ID No. 179. The ALD6 coding region plus 700 bp of upstream sequence were deleted using CRE-lox mediated marker removal (methodology described above), so the resulting locus contains one loxP site. The sequence of the modified locus is provided as SEQ ID No. 180. Finally, plasmids were introduced into the strain for expression of a variant of *Anaerostipes caccae* KAR1 (pLH702, SEQ. ID. No. 181) and DHAD (pYZ067DkivDDhADH, SEQ. ID. No. 182), resulting in strain PNY2242.

Construction of PNY1528

PNY1528 (hADH Integrations in PNY2211)

Deletions/integrations were created by homologous recombination with PCR products containing regions of homology upstream and downstream of the target region and the URA3 gene for selection of transformants. The URA3 gene was removed by homologous recombination to create a scarless deletion/integration.

The scarless deletion/integration procedure was adapted from Akada et al., Yeast, 23:399 (2006). The PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (each approximately 100 to 500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

YPRCΔ15 Deletion and Horse Liver adh Integration

The YPRCΔ15 locus was deleted and replaced with the horse liver adh gene, codon optimized for expression in *Saccharomyces cerevisiae*, along with the PDC5 promoter region (538 bp) from *Saccharomyces cerevisiae* and the ADH1 terminator region (316 bp) from *Saccharomyces cerevisiae*. The scarless cassette for the YPRCΔ15 deletion-P[PDC5]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCΔ15 Fragment A was amplified from genomic DNA with primer oBP622 (SEQ ID NO: 142), containing a KpnI restriction site, and primer oBP623 (SEQ ID NO: 143), containing a 5' tail with homology to the 5' end of YPRCΔ15 Fragment B. YPRCΔ15 Fragment B was amplified from genomic DNA with primer oBP624 (SEQ ID NO: 144), containing a 5' tail with homology to the 3' end of YPRCΔ15 Fragment A, and primer oBP625 (SEQ ID NO: 189), containing a FseI restriction site. PCR products were purified with a PCR Purification kit (Qiagen). YPRCΔ15 Fragment A—YPRCΔ15 Fragment B was created by overlapping PCR by mixing the YPRCΔ15 Fragment A and YPRCΔ15 Fragment B PCR products and amplifying with primers oBP622 (SEQ ID NO: 142) and oBP625 (SEQ ID NO: 189). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 190), containing a NotI restriction site, and primer oBP627 (SEQ ID NO: 191), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 192), containing an AscI restriction site, and primer HY24 (SEQ ID NO: 193), containing a 5' tail with homology to the 5' end of adh_Hl(y). adh_Hl(y)-ADH1t was amplified from pBP915 (SEQ ID NO: 44) with primers HY25 (SEQ ID NO: 194), containing a 5' tail with homology to the 3' end of P[PDC5], and HY4 (SEQ ID NO: 195), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 192) and HY4 (SEQ ID NO: 195).The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 142) and oBP627 (SEQ ID NO: 191).

Competent cells of PNY2211 were made and transformed with the YPRCΔ15 deletion—P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were screened for by PCR with primers URA3-end F (SEQ ID NO: 196) and oBP637 (SEQ ID NO: 197). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of YPRCΔ15 and integration of P[PDC5]-adh_HL(y)-ADH1t were confirmed by PCR with external primers oBP636 (SEQ ID NO: 198) and oBP637 (SEQ ID NO: 197) using genomic DNA prepared with a YeaStar Genomic DNA kit (Zymo Research). A correct isolate of the following genotype was selected for further modification: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1 t yprcΔ15Δ::P[PDC5]-ADH|adh_Hl-ADH1t.

Horse Liver adh Integration at fra2Δ

The horse liver adh gene, codon optimized for expression in *Saccharomyces cerevisiae*, along with the PDC1 promoter region (870 bp) from *Saccharomyces cerevisiae* and the ADH1 terminator region (316 bp) from *Saccharomyces cerevisiae*, was integrated into the site of the fra2 deletion. The scarless cassette for the fra2Δ-P[PDC1]-adh_Hl(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 199), containing a NotI restriction site, and primer oBP696 (SEQ ID NO: 137), containing a PacI restriction site. The fra2Δ Fragment C PCR product was digested with NotI and PacI and ligated with T4 DNA ligase into the corresponding sites of pUC19-URA3MCS. fra2Δ Fragment B was amplified from genomic DNA with primer oBP693 (SEQ ID NO: 201), containing a PmeI restriction site, and primer oBP694 (SEQ ID NO: 202), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 136), containing BamHI and AsiSI restriction sites, and primer oBP692 (SEQ ID NO: 204), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 205), containing an AscI restriction site, and primer HY19 (SEQ ID NO: 206), containing a 5' tail with homology to the 5' end of adh_Hl(y). adh_Hl(y)-ADH1t was amplified from pBP915 with primers HY20 (SEQ ID NO: 203), containing a 5' tail with homology to the 3' end of P[PDC1], and HY4 (SEQ ID NO: 195), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)-ADH1t PCR products and amplifying with primers HY16 (SEQ ID NO: 205) and HY4 (SEQ ID NO: 195). The resulting PCR product was digested with AscI and PmeI and ligated with T4 DNA ligase into the corresponding sites of the plasmid containing fra2Δ Fragments ABC. The entire integration cassette was amplified from the resulting plasmid with primers oBP691 (SEQ ID NO: 136) and oBP696 (SEQ ID NO: 137).

Competent cells of the PNY2211 variant with adh_Hl(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30 C. Transformants were screened for by PCR with primers URA3-end F (SEQ ID NO: 196) and oBP731 (SEQ ID NO: 139). Correct transformants were grown in YPE (1% ethanol) and plated on synthetic complete medium supplemented with 1% EtOH and containing 5-fluoro-orotic acid (0.1%) at 30 C to select for isolates that lost the URA3 marker.

The integration of P[PDC1]-adh_HL(y)-ADH1t was confirmed by colony PCR with internal primer HY31 (SEQ ID NO: 200) and external primer oBP731 (SEQ ID NO: 139) and PCR with external primers oBP730 (SEQ ID NO: 138) and oBP731 (SEQ ID NO: 139) using genomic DNA prepared with a YeaStar Genomic DNA kit (Zymo Research). A correct isolate of the following genotype was designated PNY1528: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_Hl-ADH1t adh1Δ::UAS(PGK1)P[FBA1]-kivD_Ll(y)-ADH1t yprcΔ15Δ::P[PDC5]-ADH|adh_Hl-ADH1t.

Construction of PNY1556

Described here is the assembly of the constructs used to replace the chromosomal copy of kivD_Ll(y) in PNY1528 at the adh1A locus with kivD_Lg(y) or kivD_Mc(y) and construction of strain PNY1556 expressing the kivD genes.

Deletions/integrations were created by homologous recombination with PCR products containing regions of homology upstream and downstream of the target region and the URA3 gene for selection of transformants as described in the previous section.

The plasmid to integrate kivD_Lg(y) was derived from a plasmid constructed to integrate UAS(PGK1)P[FBA1]-kivD_Ll(y) into the ADH1 locus of Saccaromyces cerevisiae. Construction of the plasmid used to integrate UAS(PGK1)P[FBA1]-kivD_Ll(y) into the ADH1 locus is described below. The plasmids were constructed in pUC19-URA3MCS.

Construction of the ADH1 Deletion/UAS(PGK1)P[FBA1]-kivD_Ll(y) Integration Plasmid The kivD coding region from *Lactococcus lactis* codon optimized for expression in *Saccharomyces cerevisiae*, kivD_Ll(y), was amplified using pLH468 (SEQ ID NO: 129) as template with primer oBP562 (SEQ ID NO: 113), containing a PmeI restriction site, and primer oBP563 (SEQ ID NO: 114), containing a 5' tail with homology to the 5' end of ADH1 Fragment B. ADH1 Fragment B was amplified from *Saccharomyces cerevisiae* CEN.PK 113-7D genomic DNA with primer oBP564 (SEQ ID NO: 115), containing a 5' tail with homology to the 3' end of kivD_Ll(y), and primer oBP565 (SEQ ID NO: 116), containing a FseI restriction site. PCR products were purified with a PCR Purification kit (Qiagen; Valencia, Calif.). kivD_Ll(y)-ADH1 Fragment B was created by overlapping PCR by mixing the kivD_Ll(y) and ADH1 Fragment B PCR products and amplifying with primers oBP562 (SEQ ID NO: 113) and oBP565 (SEQ ID NO 116). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 117), containing a SacI restriction site, and primer oBP506 (SEQ ID NO: 118), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO: 119), containing a PacI restriction site, and primer oBP508 (SEQ ID NO: 120), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-$P_{FBA1}$ was amplified from vector pRS316-UAS(PGK1)-$P_{FBA1}$-GUS (SEQ ID NO: 130) with primer oBP674 (SEQ ID NO: 121), containing an AscI restriction site, and primer oBP675 (SEQ ID NO: 122), containing a PmeI restriction site. The UAS(PGK1)-$P_{FBA1}$ PCR product was digested with AscI and PmeI and ligated with T4 DNA ligase into the corresponding sites of the plasmid containing kivD_Ll(y)-ADH1 Fragments ABC to generate pBP1181.

kivD_Ll(y) was removed from the ADH1 deletion/UAS(PGK1)P[FBA1]-kivD_Ll(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 207), containing a PmeI restriction site, and primer oBP484 (SEQ ID NO: 208), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_Ll(y) was cloned into the resulting vector for the targeted deletion of kivD_Ll(y) in PNY1528. The fragment was amplified from pBP1181 with primers oBP822 (SEQ ID NO: 209), containing a NotI restriction site, and oBP823 (SEQ ID NO: 210), containing a PacI restriction site. The fragment was digested with NotI and PacI and ligated with T4 DNA ligase into the corresponding sites downstream of URA3 in the above plasmid with the kivD_Ll(y) deletion after digestion with the appropriate restriction enzymes. The resulting plasmid was designated pBP1716.

The kivD coding region from *Listeria grayi* codon optimized for expression in *Saccharomyces cerevisiae* (SEQ ID NO: 211), kivD_Lg(y), was synthesized by DNA2.0 (Menlo Park, Calif.). kivD_Lg(y) was amplified with primers oBP828 (SEQ ID NO: 212), containing a PmeI restriction site, and oBP829 (SEQ ID NO: 213) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 97) and oBP829 (SEQ ID NO: 213). An isolate with kivD_Lg(y) in the correct orientation was designated pBP1719.

The kivD_Ll(y) deletion/kivD_Lg(y) integration cassette was amplified from pBP1719 with primers oBP505 (SEQ ID NO: 117) and oBP823 (SEQ ID NO: 210). Competent cells of the PNY1528 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_Ll(y) and integration of kivD_Lg(y) was confirmed by PCR with primers oBP674 (SEQ ID NO: 162) and oBP830 (SEQ ID NO: 214) using genomic DNA prepared with a YeaStar Genomic DNA kit (Zymo Research). A correct isolate contained kivD_Lg(y) at the same locus and expressed from the same promoter as kivD_Ll(y) in PNY1528 and was designated PNY1556.

Example 1

Expression of *Candida deformans* LIP1 Lipase in Yeast

The DNA sequence of the native LIP1 lipase from *C. deformans* was obtained from GenBank (accession number AJ428393), and the open reading frame (ORF) was optimized for expression in yeast (DNA 2.0). The resulting DNA sequence had 76% sequence identity with the wild type sequence, and encoded an identical protein.

The DNA comprising the expression-optimized ORF sequence was synthesized (DNA 2.0), and the resulting DNA molecule was cloned into a yeast-*E. coli* shuttle vector by gap-repair cloning (Oldenburg K R, Vo K T, Michaelis S, & Paddon C (1997) Recombination-mediated PCR-directed plasmid construction in vivo in yeast. Nucleic Acids Res 25:451-452). Briefly, the LIP1 lipase ORF was amplified using primers AK10-33_CdL5 and AK10-34_CdL3 (SEQ ID NOs: 10 and 11, respectively), which include 5' regions having homology to regions in plasmid pNAK34 (SEQ ID NO: 232). The resulting PCR product was co-transformed into *S. cerevisiae* strain PNY1500 with pNAK34 that had been linearized with the PacI restriction endonuclease, by lithium acetate/PEG transformation essentially as described (Gietz R D & Woods R A (2006) Yeast transformation by the LiAc/SS Carrier DNA/PEG method. Methods Mol Biol 313:107-120). The transformation reaction was plated onto synthetic complete agar medium (Sherman F (2002) Getting started with yeast. Methods in Enzymology 350:3-41) containing 2% glucose and dropout mix minus histidine (Formedium, UK, catalog number DSCK-042; SCD-His medium). After incubation at 30° C. for 3 d, H is colonies were picked for further analysis.

LIP1 lipase-positive isolates were plated onto SC-His medium containing tributyrin and incubated at 30° C. for 3 d. The LIP1 lipase-positive isolates had a zone of clearing around them, indicating that they were secreting a functional lipase enzyme capable of hydrolyzing tributyrin; in contrast, a control yeast strain did not cause clearing of tributyrin in the agar medium. The plasmids from 3 isolates were recovered by plasmid rescue (Robzyk K & Kassir Y (1992) A simple and highly efficient procedure for rescuing autonomous plasmids from yeast. Nucleic Acids Res. 20:3790) and sequenced using M13-reverse and T7-promoter primers (SEQ ID NOs: 16 and 17, respectively) on an ABI Prism 3730xl DNA Analyzer using BigDye Terminator Cycle Sequencing chemistry. The sequences were a perfect match for the predicted plasmid product of the gap-repair cloning strategy (data not shown). The resulting plasmid is pNAK10 (SEQ ID NO: 45; FIG. 3).

Example 2

Expression of *Thermomyces lanuginosus* Lipase in Yeast

The DNA sequence of the native lipase from *Thermomyces lanuginosus* (Tlan lipase) was obtained from GenBank (accession number AF054513), and the sequence was optimized for expression in yeast (DNA 2.0). The resulting DNA sequence had 76% sequence identity with the wildtype sequence, and encoded an identical protein.

The DNA comprising the expression-optimized ORF sequence was synthesized (DNA 2.0), and the resulting DNA molecule was cloned into a yeast-*E. coli* shuttle vector by gap-repair cloning as in Example 1. Briefly, the synthesized *T. lanuginosus* Tlan lipase ORF was amplified using primers AK10-42_Tl5-1 and AK10-43_Tl3 (SEQ ID NOs: 12 and 13, respectively), which include 5' regions having homology to regions in plasmid pNAK10 (SEQ ID NO: 45; FIG. 3). The resulting PCR product was co-transformed into *S. cerevisiae* strain PNY1500 with pNAK10 that had been linearized with the SpeI restriction endonuclease, by lithium acetate/PEG transformation. The transformation reaction was plated onto SCD-His medium). After incubation at 30° C. for 3 d, colonies were analyzed for plasmid containing the Tlan lipase sequence by colony PCR using primers AK10-41_Tl5-1 and AK10-42_Tl3 (SEQ ID NOs: 12 and 13).

Tlan lipase-positive isolates were plated onto SCD-His medium containing tributyrin and incubated at 30° C. for 3 d. The Tlan lipase-positive isolates had a zone of clearing around them, indicating that they were secreting a functional lipase activity; in contrast, a control yeast strain did not cause clearing of tributyrin in the agar medium. The plasmids from three isolates were recovered by plasmid rescue and sequenced using M13-reverse and T7-promoter primers (SEQ ID NOs: 16 and 17). The sequences were a perfect match for the predicted plasmid product of the gap-repair cloning strategy (data not shown). One plasmid was named pTVAN2 (SEQ ID NO: 100).

Example 3

Scale-Up Expression of *T. lanuginosus* Lipase in Yeast

One positive isolate from Example 2, PNY1020, was pre-cultured overnight in SCD-His medium, and this was used to inoculate four 500 mL cultures of SCD-His medium; two cultures were treated with the asparaginyl glycosylation inhibitor tunicamycin (5 μg/mL; Sigma-Aldrich, St. Louis Mo.). The flasks were incubated at 30° C. and 250 rpm in a shaking incubator. After 8 h 50 mL of YPD medium (yeast extract, 10 g/L; peptone, 20 g/L; glucose, 20 g/L) was added to each flask, and the cultures were incubated overnight. The following morning, after glucose was exhausted, the cultures were centrifuged at 8000 rpm for 10 min at 4° C. The supernatants were concentrated approximately 500-fold under pressure through a 10,000 dalton molecular weight cutoff filter. The protein concentration of the retentates was measured, and 20 μg of protein was analyzed by SDS-polyacrylamide gel electrophoresis, using a 4-12% acrylamide Bis-Tris gel (Invitrogen, Carlsbad Calif.) according to the manufacturer's instructions. The gel was stained with Coomassie Blue R-250, and destained. The tunicamycin-treated protein had a lower molecular weight, as demonstrated by its higher mobility in the gel (not shown). The identity of the band as Tlan lipase was confirmed by amino-terminal sequencing.

The concentration of Tlan lipase protein (expressed with or without tunicamycin treatment) in the retentates was estimated to be 25% of total soluble protein based on SDS-PAGE analysis, and these two retentates containing Tlan lipase protein (expressed with or without tunicamycin treatment) were employed as catalyst for in-vitro esterification of isobutanol with corn oil fatty acids (Example 5).

Example 4

Production of Corn Oil Fatty Acids

A 5-L round bottom flask was equipped with a mechanical stirrer, thermocouple, heating mantle, condenser and nitrogen tee and charged with 750 g of crude corn oil, 2112 g of water and 285 g of 50% sodium hydroxide solution. Mixture was heated to 90° C. and held for two hours, during which time it became a thick, emulsion-like single phase. At the end of this time thin-layer chromatography indicated no remaining corn oil in the mixture. The mixture was then cooled to 74° C. and 900 g of 25% sulfuric acid was added to acidify the mixture, which was then cooled to 50° C. and the aqueous layer was separated. The oil layer was washed twice with 1500 mL of 40° C. water and then once with 1 L of saturated brine, and then dried over magnesium sulfate and filtered through Celite. Yield was 610 g of clear red oil. Titration for Free Fatty Acids via AOCS method Ca 5a-40 shows a fatty acid content of 95% expressed as oleic acid. A sample (104 mg) was silanized by reaction with 100 uL of N-methyl-N-(trimethylsilyl)-trifluoroacetamide in 1 mL of dry pyridine. Gas chromatography-mass spectrometry (GCMS) analysis of the silanized product indicated the presence of the TMS derivatives of the 16:0, 18:2, 18:1, 18:0, and 20:0 carboxylic acids.

Example 5

Production of Isobutyl-COFA Esters by Reaction of Isobutanol and Corn Oil Fatty Acids Catalyzed by Secreted Lipase Reaction mixtures containing 3.6 g isobutanol (2-methyl-1-propanol), 14.7 g corn oil fatty acids (COFA) prepared from corn oil (Example 4), 45.1 g of aqueous 2-(N-morpholino) ethanesulfonic acid buffer (0.20 M, pH 5.4), and either 0.487 mg (10 ppm in aqueous phase; Table 7) or 0.974 mg (20 ppm in aqueous phase; Table 9) of Tlan lipase protein (expressed with or without tunicamycin treatment; Example 3) were stirred at 30° C., and samples were withdrawn from each reaction mixture at predetermined times, immediately centrifuged, and the aqueous and organic layers separated and analyzed for isobutanol (iBuOH) and isobutyl-esters of corn oil fatty acids (iBuO-COFA) (Table 10). The reactions containing Tlan lipase produced considerably more iBuO-COFA than the control reaction; the lipase samples that were secreted from yeast in the presence of tunicamycin produced considerably more iBuO-COFA than that produced without the inhibitor being present.

TABLE 9

Tlan concentrations in reactions for conversion of isobutanol (iBuOH) to iso-butyl esters of corn oil fatty acids (iBuO-COFA).

| Reaction | Tlan (ppm) | expressed with tunicamycin |
|---|---|---|
| 1 | 10 | no |
| 2 | 20 | no |
| 3 | 10 | yes |
| 4 | 20 | yes |
| 5 | 0 | not applicable |

TABLE 10

Weights of isobutanol (iBuOH) and isobutyl esters of corn oil fatty acids (iBuO-COFA) present in the aqueous fraction (AQ) and organic fraction (ORG) for reactions described in Table 9.

| reaction | time (h) | total iBuOH (g) (AQ) | total iBuOH (g) (ORG) | free iBuOH (g) (ORG) | iBuOH from iBuO-COFA (g) (ORG) | iBuO-COFA (g) (ORG) |
|---|---|---|---|---|---|---|
| 1 | 0.1 | 1.45 | 2.15 | 2.14 | 0.01 | 0.03 |
| 1 | 16 | 1.27 | 2.33 | 2.31 | 0.02 | 0.09 |
| 1 | 21 | 1.27 | 2.33 | 2.30 | 0.03 | 0.14 |
| 1 | 47 | 1.24 | 2.36 | 2.28 | 0.08 | 0.36 |
| 1 | 89 | 1.23 | 2.37 | 2.22 | 0.15 | 0.67 |
| 2 | 0.1 | 1.22 | 2.39 | 2.38 | 0.01 | 0.03 |
| 2 | 16 | 1.29 | 2.32 | 2.30 | 0.03 | 0.11 |
| 2 | 21 | 1.25 | 2.36 | 2.32 | 0.04 | 0.17 |
| 2 | 47 | 1.38 | 2.23 | 2.14 | 0.09 | 0.38 |
| 2 | 89 | 1.21 | 2.40 | 2.18 | 0.22 | 0.98 |
| 3 | 0.1 | 1.22 | 2.43 | 2.42 | 0.01 | 0.03 |
| 3 | 16 | 1.28 | 2.37 | 2.28 | 0.09 | 0.41 |
| 3 | 21 | 1.24 | 2.41 | 2.29 | 0.12 | 0.55 |
| 3 | 47 | 1.22 | 2.43 | 2.15 | 0.28 | 1.27 |
| 3 | 89 | 1.17 | 2.48 | 1.94 | 0.54 | 2.42 |
| 4 | 0.1 | 1.38 | 2.22 | 2.21 | 0.01 | 0.03 |
| 4 | 16 | 1.30 | 2.30 | 2.19 | 0.11 | 0.49 |
| 4 | 21 | 1.21 | 2.39 | 2.23 | 0.15 | 0.69 |
| 4 | 47 | 1.36 | 2.24 | 1.90 | 0.34 | 1.51 |
| 4 | 89 | 1.12 | 2.48 | 1.78 | 0.70 | 3.16 |
| 5 | 0.1 | 1.29 | 2.30 | 2.30 | 0.01 | 0.03 |

TABLE 10-continued

Weights of isobutanol (iBuOH) and isobutyl esters of corn oil fatty acids (iBuO-COFA) present in the aqueous fraction (AQ) and organic fraction (ORG) for reactions described in Table 9.

| reaction | time (h) | total iBuOH (g) (AQ) | total iBuOH (g) (ORG) | free iBuOH (g) (ORG) | iBuOH from iBuO-COFA (g) (ORG) | iBuO-COFA (g) (ORG) |
|---|---|---|---|---|---|---|
| 5 | 16 | 1.27 | 2.32 | 2.30 | 0.02 | 0.08 |
| 5 | 21 | 1.24 | 2.35 | 2.33 | 0.02 | 0.10 |
| 5 | 47 | 1.35 | 2.24 | 2.20 | 0.05 | 0.21 |
| 5 | 89 | 1.25 | 2.35 | 2.27 | 0.07 | 0.33 |

Example 6

Production of Fatty Acid Butyl Esters During Yeast Cultivation

The Tlan lipase isolate PNY1020 and the control strain PNY908 were pre-cultured in SCD-His medium, and used to inoculate flasks (with non-vented caps) containing 25 mL of SC-His medium. The flasks were amended with 8.25 g sterile COFA (33% w/w), isobutanol (0.50 g, added after 8 h of growth), and tunicamycin (Tnm, final concentration 5 µg/ml) as follows (Table 11):

TABLE 11

| | PNY908 | | | | PNY1020 | | |
|---|---|---|---|---|---|---|---|
| Flask | COFA | iBuOH | Tnm | flask | COFA | iBuOH | Tnm |
| F1 | − | − | − | F5 | − | − | − |
| F2 | + | − | − | F6 | + | − | − |
| F3 | − | + | − | F7 | − | + | − |
| F4 | + | + | − | F8 | + | + | − |
| | | | | F9 | + | + | + |
| | | | | F10 | + | − | + |

The flasks were incubated at 30° C. and 250 rpm, and sampled after 24 h and 96 h of incubation. Samples were analyzed for glucose, ethanol, isobutanol, and fatty acid alkyl esters in the aqueous phase by HPLC or GC, and for isobutanol and fatty acid alkyl esters in the organic phase by GC (Tables 12 and 13). When both isobutanol and COFA were added to the cultures, the lipase-expressing strain (flasks F8 and F9) produced more iBuO-COFA than the control strain (flask F4). The cells treated with tunicamycin produced more ester than the cells without inhibitor treatment.

TABLE 12

HPLC analysis of aqueous F1-F10 samples.

| sample | time (h) | glucose (mM) | glycerol (mM) | acetate (mM) | ethanol (mM) | iBuOH (mM) |
|---|---|---|---|---|---|---|
| F1 | 24 | 0.1 | 2.5 | 8.2 | 170.4 | 0.8 |
| F2 | 24 | 0.1 | 3.3 | 7.3 | 179.4 | 1.2 |
| F3 | 24 | 50.9 | 1.6 | 3.5 | 106.4 | 266.6 |
| F4 | 24 | 0.0 | 1.5 | 5.5 | 182.0 | 144.3 |
| F5 | 24 | 0.1 | 3.9 | 10.5 | 171.1 | 0.5 |
| F6 | 24 | 0.1 | 5.0 | 7.9 | 184.7 | 0.1 |
| F7 | 24 | 89.9 | 1.1 | 2.4 | 39.0 | 267.2 |
| F8 | 24 | 0.1 | 1.8 | 1.7 | 189.9 | 144.6 |
| F9 | 24 | 65.9 | 1.7 | 2.6 | 80.7 | 143.5 |
| F10 | 24 | 10.8 | 16.6 | 5.4 | 141.6 | 0.4 |
| F1 | 96 | 0.0 | | 0.7 | 91.7 | 0.3 |
| F2 | 96 | 0.0 | 3.1 | 7.0 | 179.3 | 0.1 |
| F3 | 96 | 50.6 | 1.2 | 3.0 | 108.6 | 247.9 |
| F4 | 96 | 0.0 | 1.6 | 7.2 | 183.8 | 130.0 |
| F5 | 96 | 0.0 | 3.3 | 9.2 | 163.9 | 0.1 |
| F6 | 96 | 0.0 | 4.9 | 9.7 | 182.6 | 0.1 |
| F7 | 96 | 90.3 | 0.9 | 1.5 | 38.6 | 248.6 |
| F8 | 96 | 0.0 | 1.9 | 2.0 | 190.7 | 128.1 |
| F9 | 96 | 0.7 | 2.1 | 1.2 | 184.2 | 128.5 |
| F10 | 96 | 0.0 | 17.8 | 2.2 | 153.2 | 0.1 |

TABLE 13

Weights of isobutanol (iBuOH) and isobutyl esters of corn oil fatty acids (iBuO-COFA) present in the aqueous fraction (AQ) and organic fraction (ORG) for shake flask cultures described in Table 11.

| flask | time (h) | total iBuOH (mg) (AQ) | total iBuOH (mg) (ORG) | free iBuOH (mg) (ORG) | iBuOH from iBuO-COFA (mg) (ORG) | iBuO-COFA (mg) (ORG) |
|---|---|---|---|---|---|---|
| F1 | 24 | 0 | | | | |
| F1 | 96 | 0 | | | | |
| F2 | 24 | 0 | 0 | 0 | 0.0 | 0.0 |
| F2 | 96 | 0 | 0 | 0 | 0.0 | 0.0 |
| F3 | 24 | 439 | | | | |
| F3 | 96 | 447 | | | | |
| F4 | 24 | 239 | 262 | 257 | 4.7 | 21.1 |
| F4 | 96 | 247 | 255 | 239 | 15.4 | 69.5 |
| F5 | 24 | 0 | | | | |
| F5 | 96 | 0 | | | | |
| F6 | 24 | 0 | 0 | 0 | 0.0 | 0.0 |
| F6 | 96 | 0 | 0 | 0 | 0.0 | 0.0 |
| F7 | 24 | 446 | | | | |
| F7 | 96 | 443 | | | | |
| F8 | 24 | 231 | 271 | 266 | 5.0 | 22.5 |
| F8 | 96 | 234 | 267 | 251 | 16.0 | 72.1 |
| F9 | 24 | 234 | 267 | 262 | 4.9 | 22.0 |
| F9 | 96 | 224 | 278 | 261 | 16.6 | 74.9 |
| F10 | 24 | 0 | 0 | 0 | 0.0 | 0.0 |
| F10 | 96 | 0 | 0 | 0 | 0.0 | 0.0 |

Example 7

Expression of *Candida antarctica* Lipase B in Yeast

The DNA sequence for the *Candida antarctica* lipase B (CalB lipase) was obtained from GenBank (accession number Z30645), and the sequence was optimized for expression in yeast (DNA 2.0, Menlo Park, Calif.). The resulting DNA sequence had 72% sequence identity with the wildtype sequence, and encoded an identical protein.

The DNA comprising the expression-optimized CalB open reading frame (ORF) sequence was synthesized (DNA 2.0), and the resulting DNA molecule was cloned into a yeast-*E. coli* shuttle vector by gap-repair cloning. Briefly, the CalB lipase ORF was amplified using primers CALBL_gap_for and CALBL_gap_rev (SEQ ID NOs: 14 and 15), which include 5' regions having homology to regions in plasmid pNAK34 (SEQ ID NO: 232). The resulting PCR product was co-transformed into *S. cerevisiae* strain PNY1500 with plasmids pNAK33 (SEQ ID NO: 231), pNAK34 (SEQ ID NO: 232), or pNAK35 (SEQ ID NO: 233) that had been linearized with the HpaI restriction endonuclease, by lithium acetate/PEG transformation. The transformation reaction was plated onto SCD-His medium. After incubation at 30° C. for 3 days, colonies were analyzed for plasmid containing the CalB lipase sequence by colony PCR using primers CALBL_gap_for and CALBL_gap_rev (SEQ ID NOs: 14 and 15).

CalB lipase-positive isolates were plated onto SCD-His medium containing tributyrin and incubated at 30° C. for 3 days. The CalB lipase-positive isolates had a zone of clearing around them, indicating that they were secreting a functional lipase activity; in contrast, a control yeast strain did not cause clearing of tributyrin in the agar medium. The plasmids from 3 isolates were recovered by plasmid rescue and sequenced using M13-reverse and T7-promoter primers (SEQ ID NOs: 16 and 17). The sequences were a perfect match for the predicted plasmid product of the gap-repair cloning strategy. The resulting plasmids were named pTVAN7 (TEF1(M2) promoter), pTVAN3 (TEF1(M4) promoter), and pTVAN8 (TEF1(M6) promoter) (SEQ ID NOs: 278, 101, and 240, respectively).

Example 8

Surface Display of Tlan Lipase

A domain that tethers the secreted *T. lanuginosus* lipase to the yeast cell surface was introduced as follows. Yeast genomic DNA (PNY1500) was used as template in a PCR reaction with primers AK11-46 and AK11-47 (SEQ ID NOs: 215 and 216, respectively), which amplified the codons for the C-terminal 320 amino acids of the yeast α-agglutinin protein encoded by SAG1, and added a sequence at the 5' end containing a glycine- and serine-rich linker region. Amplification was done with Phusion DNA polymerase (New England Biolabs) according to the manufacturer's instructions.

This GS-SAG1 DNA was TOPO cloned into pCR-BluntII-TOPO (InVitrogen) and transformed into DH5α. The pGS-SAG1 plasmid (SEQ ID NO: 217) was recovered by miniprep (Qiagen) and the correct sequence was confirmed by DNA sequencing. The DNA was amplified with primers Sagtgap1 and Sagtgap2 (SEQ ID NOs: 218 and 219, respectively) which include regions of homology for gap-repair cloning into lipase expression vectors pTVAN11, pTVAN12, and pTVAN13 (SEQ ID NOs: 220, 221, and 222, respectively). The purified PCR products were transformed into yeast strain PNY1500 along with PacI-digested pTVAN11 (TEF1(M2) promoter), pTVAN12 (TEF1(M4) promoter), or pTVAN13 (TEF1(M6) promoter). The transformation reactions were plated to SCD-His medium; colonies that appeared tested positive for expression of lipase activity on tributyrin plates. Plasmids were rescued from these isolates (Yeast Plasmid Miniprep Kit, Zymo Research) and transformed into *E. coli* DH5α and purified. Sequence analysis showed the expected nucleotide sequence of the lipase-SAG1 chimera.

The lipase-expressing strains (PNY1052, PNY1053, and PNY1054) and the control strain (PNY1500) were grown overnight in 50 mL SCD-His medium, in a 250 mL vented-cap flask incubated at 30° C. and 250 rpm. The following morning, 21.5 mL of the culture was transferred to a 125 mL flask (unvented cap), with addition of 1.75 mL glucose (500 g/L), 2.5 mL 10×YEP (100 g/L yeast extract, 200 g/L peptone), and 0.313 mL isobutanol. A sample was taken, then 10.3 mL COFA and a sterile stir bar were added and the flasks returned to incubation. A sample (5 mL) was taken after 24 h for HPLC and GC analysis, and 1.75 mL glucose and 0.313 mL isobutanol were added. A second sample was taken after 72 h. Samples were analyzed as described above (Table 14). The strains expressing the SAG1-lipase chimera produced more fatty acid butyl ester (FABE) than the control strain. Strain PNY1054, which had the strongest promoter driving transcription of the chimera, produced greater than 6-fold more FABE than the control, whereas the strains with weaker promoters produced only ~30% more FABE than the control.

TABLE 14

Measured amounts of isobutanol (iBuOH) and fatty acid isobutyl ester (FABE) in aqueous and organic phases of shake flask cultivations of the strain indicated.

| Strain | iBuOH in rxn, mg (AQ) | iBuOH in rxn, mg (ORG) | FABE in rxn, mg (ORG) |
|---|---|---|---|
| 24 h | | | |
| PNY1052 | 226 | 255 | 29 |
| PNY1053 | 224 | 252 | 30 |
| PNY1054 | 230 | 248 | 167 |
| PNY1500 | 221 | 245 | 25 |
| 72 h | | | |
| PNY1052 | 201 | 204 | 52 |
| PNY1053 | 197 | 202 | 52 |
| PNY1054 | 206 | 188 | 264 |
| PNY1500 | 195 | 196 | 39 |

Example 9

Cell Surface Display: Cell-Association Test

This experiment was conducted to determine whether the lipase activity expressed by the SAG1-lipase chimera was in fact cell-associated or was secreted into the culture broth.

The lipase-expressing strains (PNY1052, PNY1053, and PNY1054) and the control strain (PNY1500) were grown for 24 h in 25 mL SCD-His medium (6.7 g/L yeast nitrogen base without amino acids, 1926 mg dropout mix minus histidine, 20 g/L glucose), in a 250 mL vented-cap flask incubated at 30° C. and 250 rpm. Then the cells and culture broth were separated by centrifugation; the cell pellet was washed twice and resuspended in 25 mL 50 mM MES buffer pH 5.5. The spent cell-free culture medium was amended with 1 M MES buffer pH 5.5 to 50 mM. Isobutanol (final concentration 20 g/L) and COFA (33% wt/wt) were added to the spent medium and to the cell suspension. The two reactions were incubated for 72 h at 30° C. and 250 rpm. Samples were analyzed by GC as described above (Table 15). The suspensions of lipase-expressing cells formed ~2.5-fold more FABE than the control cell suspension, after incubation for 72 h with COFA and isobutanol. In contrast, there was no difference in FABE accumulation in the cell-free medium samples, demonstrating that the Sag1-lipase chimeric protein is exclusively cell-associated under these conditions.

TABLE 15

Measured amounts of isobutanol (iBuOH) and fatty acid isobutyl ester (FABE) in aqueous and organic phases of shake flask cultivations of the strain indicated.

| Strain | iBuOH in rxn, mg (AQ) | iBuOH in rxn, mg (ORG) | FABE in rxn, mg (ORG) |
|---|---|---|---|
| Cell-free medium | | | |
| PNY1052 | 215.1 | 236.3 | 56.2 |
| PNY1053 | 211.0 | 236.8 | 56.1 |
| PNY1054 | 221.1 | 269.1 | 63.5 |
| PNY1500 | 208.7 | 256.6 | 60.3 |

TABLE 15-continued

Measured amounts of isobutanol (iBuOH) and fatty acid isobutyl ester (FABE) in aqueous and organic phases of shake flask cultivations of the strain indicated.

| Strain | iBuOH in rxn, mg (AQ) | iBuOH in rxn, mg (ORG) | FABE in rxn, mg (ORG) |
|---|---|---|---|
| Cells suspended in MES buffer | | | |
| PNY1052 | 226.3 | 204.1 | 143.0 |
| PNY1053 | 224.2 | 209.2 | 151.9 |
| PNY1054 | 230.3 | 211.6 | 137.8 |
| PNY1500 | 221.1 | 225.8 | 55.9 |

Example 10

Engineering Isobutanol-Producing Yeast to Secrete *T. lanuginosus* Lipase

The Tlan lipase transgene was amplified from plasmid pTVAN6 (SEQ ID NO: 183) with oligonucleotides AK11-24 (SEQ ID NO: 132) and AK11-25 (SEQ ID NO: 133), which include AscI sites at their 5' ends. The PCR products were digested with AscI and ligated into AscI-digested pBP1236 (SEQ ID NO: 185). This plasmid is used to apply the technique of Akada et al. (Akada R et al. (2006) PCR-mediated seamless gene deletion and marker recycling in *Saccharomyces cerevisiae*. Yeast 23:399-405) for integration of transgenes at the fra2Δ locus of yeast. The ligation mixture was transformed into competent *E. coli* DH5α (Invitrogen, Carlsbad Calif.) and plated onto LB-ampicillin agar. Colonies from this plate were grown overnight in LB-ampicillin, and plasmid DNA was isolated using the Qiaprep Spin Miniprep kit. Recombinant plasmids were identified by digestion with AscI and agarose gel electrophoresis. DNA sequencing was used to identify the orientation of the lipase transgenes in the construct. Plasmid pNAK15 (SEQ ID NO: 186) contains the wildtype lipase transgene in the reverse direction, and pNAK16 (SEQ ID NO: 187) contains the wildtype lipase transgene in the forward orientation.

The lipase transgenes were amplified from these plasmids along with flanking DNA that targets them for integration at fra2Δ (and which includes the URA3 gene as a selectable marker) using primers oBP691 (SEQ ID NO: 136) and oBP696 (SEQ ID NO: 137). The PCR products were purified and concentrated using a QIAQuick PCR Purification kit. Yeast strain PNY2211 (construction described above) was grown overnight in YPE medium (10 g/L yeast extract, 20 g/L peptone, 20 mL/l 95% ethanol) at 30° C. and 250 rpm, and transformed with the PCR products followed by plating to SCE-Ura agar medium (6.7 g/L yeast nitrogen base without amino acids (YNB; Difco 291940, BD, Franklin Lakes N.J.), 1926 mg/L dropout mix -Ura (DSCK102, Formedium, Norfolk UK), 20 mL/L 95% ethanol). Ura+ colonies were plated to fresh medium, and then re-plated to FOA medium (6.7 g/L YNB, 1 g/L 5-fluoroorotic acid, 200 mg/L uracil, 20 mL/l 95% ethanol) to select for isolates that had lost the URA3 selection marker.

FOA-resistant transformants were checked for correct integration of the transgene and loss of the selection marker by colony PCR using primer pairs for each flank of the integration cassette as follows: for the construct with the transgene in the forward orientation (from pNAK16), primer pairs AK11-26 (SEQ ID NO: 134) and oBP730 (SEQ ID NO: 138), and AK11-27 (SEQ ID NO: 135) and oBP731 (SEQ ID NO: 139), were used; for the construct with the transgene in the reverse orientation (from pNAK15 and pNAK17), primer pairs AK11-27 (SEQ ID NO: 135) and oBP730 (SEQ ID NO: 138), and AK11-26 (SEQ ID NO: 134) and oBP731 (SEQ ID NO: 139), were used. Isolates that produced the correct PCR products were chosen for further study, and named PNY931 (reverse orientation), PNY932 (forward orientation), and PNY933 (reverse orientation, N55A mutation).

Mutagenesis of the asparagine at residue 55 of Tlan lipase (in the N-glycosylation site) to alanine was carried out with the QuikChange Site-Directed Mutagenesis Kit (Strategene, La Jolla Calif.) according to the manufacturer's instructions, combining plasmid pNAK15 (SEQ ID NO: 186) and the following primers:

| SEQ ID NO | Primer | Sequence |
|---|---|---|
| 140 | TILipNAfor | GATGCCCCAGCAGGGACAGCTATTACATGTACTGGAAACGC |
| 141 | TILipNArev | GCGTTTCCAGTACATGTAATAGCTGTCCCTGCTGGGGCATC |

After amplification of the plasmid backbone with mutagenic primers using the thermostable polymerase provided with the kit, the DNA was digested with DpnI restriction endonuclease. The treated plasmids were transformed into *E. coli* XL1-Blue competent cells, and recovered using the Qiaprep Spin Miniprep Kit (Qiagen, Valencia, Calif.). Mutated clones were identified by DNA sequence analysis of the mutagenized plasmids. One such plasmid was named pNAK17 (SEQ ID NO: 189).

The lipase integrant yeast strains, and their parent strain PNY2211, were transformed with plasmids pBP915 (SEQ ID NO: 44) and pYZ090ΔalsS (SEQ ID NO: 43) in order to introduce an isobutanol metabolic pathway. The strains were cultivated overnight in YPE medium, then transformed with plasmid DNA as described above, and plated to SCE-His-Ura agar medium (6.7 g/L YNB, 1850 mg/L dropout mix -His-Ura (DSCK162, Formedium), 20 mL/l 95% ethanol). Colonies were re-plated to SCE-His-Ura agar medium, and named PNY934, PNY935, and PNY936.

Example 11

Production of Isobutanol and Fatty Acid Isobutyl Esters by Heterologous Lipase Expression Strains PNY934 and PNY935 were replated to SC-His-Ura DE agar medium (6.7 g/L YNB, 1850 mg/L dropout mix -His-Ura, 3 g/L glucose, 3 mL/l 95% ethanol); these cells, along with cells of a control strain PNY2242 (which produces isobutanol but does not secrete heterologous lipase) were used to inoculate 3 mL pre-cultures of SC-His-Ura DE medium. These were grown ~6 h. Two mL were used to inoculate 50 mL of the same medium in 250 mL flasks with vented caps; these were grown overnight to an optical density ($OD_{600}$) of ~1. The next morning, glucose, yeast extract, and peptone were added to concentrations of 35, 10, and 20 g/L, respectively, with a final volume of 75 mL. This was divided evenly among triplicate 125 mL shake flasks (non-vented caps, containing a stir bar), and then 10.3 mL of corn oil fatty acid (COFA) was added and the flasks were incubated at 30° C. and 250 rpm. Samples were taken at 0 h (0.6 mL, before COFA addition), and at 24 h and 72 h (5 mL each, after thorough mixing of the aqueous and COFA phases). Samples were analyzed by HPLC and GC as previously described. At 24 h, 1.5 mL of 500 g/L glucose was added.

The isobutanol produced in these fermentations was distributed among 3 fractions: free isobutanol in the aqueous and COFA phases, and a fatty acid isobutyl ester (FABE) fraction produced by the esterification of isobutanol with fatty acids. As shown in Table 16, the lipase-secreting strains produced considerable amounts of FABE, whereas the control strain produced only a low amount, ~12% of that produced by the lipase-secreting strains. The lipase-catalyzed esterification of isobutanol into FABE resulted in a decrease in the aqueous isobutanol concentration as a percent of the total amount of isobutanol in the system by about 10%, from 53% to 43% at 24 h, and from 45% to ~31% at 72 h.

TABLE 16

Measured amounts of isobutanol (iBuOH) and fatty acid isobutyl ester (FABE) in aqueous and organic phases of shake flask cultivations of the strain indicated. Mean ± standard deviation of triplicate flasks is shown. Amounts are corrected for volume loss due to sampling.

| | iBuOH in rxn, mg (AQ) | iBuOH in rxn, mg (ORG) | FABE in rxn, mg (ORG) |
|---|---|---|---|
| | | 24 h | |
| PNY934 | 42.2 ± 0.9 | 32 ± 3.4 | 103.3 ± 4.7 |
| PNY935 | 49.7 ± 14.9 | 41.3 ± 15.6 | 106.5 ± 13.8 |
| PNY2242 | 93 ± 0.4 | 78.3 ± 2.5 | 15.1 ± 0.1 |
| | | 72 h | |
| PNY934 | 37.9 ± 3.2 | 32.8 ± 1.1 | 283 ± 43.3 |
| PNY935 | 50.4 ± 20.8 | 32 ± 1.2 | 284.4 ± 57.6 |
| PNY2242 | 97.6 ± 57.3 | 112.5 ± 31.8 | 34.9 ± 3.5 |

Example 12

Production of Isobutanol and Fatty Acid Isobutyl Esters by Heterologous Lipase Secretion—Comparing Glycosylated and Non-Glycosylated Lipase The experiment of the previous example was repeated, with the inclusion of strain PNY936, which secretes the N55A mutant of Tlan lipase. In this experiment, glucose was added twice, after 24 h and again after 48 h (1.5 mL of 500 g/L glucose).

The lipase-secreting strains produced more FABE than the control strain (in this instance ~5-6-fold more). The proportion of the total isobutanol in the aqueous fraction was decreased as a consequence of FABE formation, by ~10% at 24 h and by ~15% at 72 h. The cultures in which lipase-secreting isobutanologens were grown produced significantly more FABE fraction than the control. The amount of FABE produced in the fermentation with the PNY936 strain (secreting glycosylation-mutant lipase) did not differ significantly from that produced by the strains secreting the wildtype lipase enzyme.

TABLE 17

Measured amounts of isobutanol (iBuOH) and fatty acid isobutyl ester (FABE) in aqueous and organic phases of shake flask cultivations of the strain indicated. Mean ± standard deviation of triplicate flasks is shown. Amounts are corrected for volume loss due to sampling.

| | iBuOH in rxn, mg (AQ) | iBuOH in rxn, mg (ORG) | FABE in rxn, mg (ORG) |
|---|---|---|---|
| | | 24 h | |
| PNY934 | 36.3 ± 6.5 | 31.3 ± 5.8 | 89.1 ± 6.8 |
| PNY935 | 33.2 ± 2 | 27.5 ± 1.4 | 76.5 ± 5.5 |
| PNY936 | 34.8 ± 1 | 28.8 ± 0.8 | 74.5 ± 1.3 |
| PNY2242 | 75.1 ± 4.3 | 63.4 ± 3 | 14 ± 0.1 |
| | | 72 h | |
| PNY934 | 48.3 ± 6.2 | 41 ± 4.6 | 197.6 ± 20.3 |
| PNY935 | 45.2 ± 3.6 | 39.6 ± 5.8 | 184.2 ± 13.4 |
| PNY936 | 46.4 ± 1.8 | 38.7 ± 1.3 | 203.7 ± 24.4 |
| PNY2242 | 143.4 ± 20.8 | 135.9 ± 22.7 | 34.3 ± 2.1 |

Example 13

Engineering Isobutanol-Producing Yeast to Express *C. deformans* and *C. antarctica* Lipases The LIP1 and CalB lipase transgenes encoding the wild-type lipases from *C. deformans* and *C. antarctica*, respectively, were amplified from plasmids pNAK10 (SEQ ID NO: 45), pNAK31 (SEQ ID NO: 238), and pTVAN8 (SEQ ID NO: 240) with oligonucleotides AK11-24 (SEQ ID NO: 132) and AK11-25 (SEQ ID NO: 133), which include AscI sites at their 5' ends. The PCR products were digested with AscI and ligated into AscI-digested pNAK36 (SEQ ID NO: 223). The ligation mixture was transformed into competent *E. coli* DH5α (Invitrogen) and plated onto LB-ampicillin agar. Colonies from this plate were grown overnight in LB-ampicillin, and plasmid DNA was isolated using the Qiaprep Spin Miniprep kit. Recombinant plasmids were identified by digestion with AscI and agarose gel electrophoresis. Plasmid pNAK38 (SEQ ID NO: 224) contains the CalB lipase under control of the TEF1(M6) promoter, pNAK37 (SEQ ID NO: 225) contains the LIP1 lipase under control of the TEF1(M4) promoter, and pNAK39 (SEQ ID NO: 226) contains the LIP1 lipase under control of the TEF1(M6) promoter.

The lipase transgenes were amplified from these plasmids along with flanking DNA that targets them for integration at gpd2Δ (and which includes the URA3 gene as a selectable marker) using primers oBP691 (SEQ ID NO: 136) and oBP696 (SEQ ID NO: 137). The PCR products were purified and concentrated using a QIAQuick PCR Purification kit. Yeast strain PNY1556 was grown overnight in YPE medium (10 g/l yeast extract, 20 g/l peptone, 20 ml/195% ethanol) at 30° C. and 250 rpm, and transformed with the PCR products followed by plating to SCE-Ura agar medium. Ura$^+$colonies were plated to fresh medium, and then re-plated to FOA medium to select for isolates that had lost the selectable marker.

FOA-resistant transformants were checked for correct integration of the transgene and loss of the selectable marker by colony PCR using primer pairs for each flank of the integration cassette as follows: genomic DNA was purified using the PureGene kit (Qiagen) essentially as described by the manufacturer. This was used as template for a PCR reaction with oligos HY48 (SEQ ID NO: 227) and HY49 (SEQ ID NO: 228). Positive integrants were plated to FOA medium, and FOA-resistant isolates were recovered. Isolates which had lost the URA3 marker from the gpd2Δ locus were identified by PCR using oligos HY48 and HY49 as described above.

The lipase integrant yeast strains and the control strain, PNY1556, were transformed with plasmid pBP2092 (SEQ ID NO: 237) in order to introduce an isobutanol metabolic pathway, as follows: The strains were cultivated overnight in YPE medium, then transformed with plasmid DNA as described above, and plated to SCE-His agar medium. Colonies were re-plated to SCE-Ura agar medium, and named PNY1022 (TEF1(M4)-LIP1), PNY1023 (TEF1(M6)-LIP1), and PNY1024 (TEF1(M4)-CalB).

Example 14

Production of Isobutanol and Fatty Acid Isobutyl Esters by Heterologous Expression of *C. deformans* and *C. antarctica* Lipases in an Isobutanologen Strains PNY1022, PNY1023, and PNY1024 were replated to SC-Ura DE agar medium; these cells were used to inoculate 3 ml pre-cultures of SC-His-Ura DE medium, which were grown ~6 h. Two ml were used to inoculate 50 ml of the same medium in 250 ml flasks with vented caps; these were grown overnight to an optical density ($OD_{600}$) of ~1. The next morning glucose, yeast extract, and peptone were added to concentrations of 35, 10, and 20 g/l, respectively, with a final volume of 75 ml. This was divided evenly among triplicate 125 ml shake flasks (non-vented caps, containing a stir bar), 10.3 ml of corn oil fatty acid (COFA) was added, and the flasks were incubated at 30° C. and 250 rpm. Samples were taken at 0 h (before COFA addition), and at 24 h, 48 h, and 94 h, after thorough mixing of the aqueous and COFA phases. Samples were analyzed by HPLC and GC. At 24 h, 1.5 mL of 500 g/L glucose was added (1.2 mL to the PNY1556 culture); at 48 h, 1.6 mL of glucose was added to each flask.

The isobutanol produced in these fermentations was distributed among 3 phases: free isobutanol in the aqueous and COFA phases, and fatty acid isobutyl ester (FABE) produced the esterification of isobutanol with fatty acids. As shown in Table 18, the strains expressing the *C. deformans* lipase produced considerable amounts of FABE at both 24 and 94 h. PNY1023, which has a stronger promoter driving expression of the *C. deformans* lipase transgene, makes approx. twice as much FABE as PNY1022. Interestingly, by 94 h PNY1023 produced significantly more total isobutanol than the other strains.

The strain expressing the CalB lipase produced much less FABE than the strains expressing the *C. deformans* enzyme, although there was significantly more FABE in its flasks than in the control fermentations. The control strain (with no lipase transgene) esterified only 10 mg of isobutanol into FABE by 94 h, presumably due to endogenous lipase activity. The fermentations carried out by lipase-expressing isobutanologens are all marked by a significantly lower aqueous isobutanol concentration than the control fermentations. In the case of the fermentations with *C. deformans*-expressing strains (PNY1022 and PNY1023), this corresponds with a significant accumulation of FABE; the strain expressing the *C. antarctica* accumulated much less ester. For the *C. deformans*-expressing strains, the total isobutanol production is comparable to the no-lipase control when a weak promoter is used to express the lipase gene; when a strong promoter is used, the total isobutanol production is 24% higher than the control.

TABLE 18

Measured amounts of isobutanol (iBuOH) and fatty acid isobutyl ester (FABE) in aqueous and organic phases of shake flask cultivations of the strain indicated.

| Strain | iBuOH in rxn, mg (AQ) | iBuOH in rxn, mg (ORG) | FABE in rxn, mg (ORG) |
|---|---|---|---|
| 24 h | | | |
| PNY1022 | 126 ± 3 | 98 ± 2 | 290.7 ± 16.6 |
| PNY1023 | 94 ± 5 | 67 ± 0 | 534.2 ± 26.1 |
| PNY1024 | 157 ± 4 | 133 ± 4 | 23.7 ± 2 |
| PNY1556 | 187 ± 5 | 112 ± 3 | 7.6 ± 0.5 |
| 94 h | | | |
| PNY1022 | 211 ± 3 | 139 ± 3 | 559.8 ± 8.3 |
| PNY1023 | 206 ± 19 | 126 ± 14 | 1182.7 ± 14.3 |
| PNY1024 | 204 ± 37 | 143 ± 31 | 131.1 ± 11.7 |
| PNY1556 | 271 ± 4 | 195 ± 1 | 42.8 ± 0.6 |

Example 15

Expression of *Aspergillus tubingensis* LIP3 Lipase in Yeast

The DNA encoding the *Aspergillus tubingensis* LIP3 lipase was synthesized (DNA 2.0) with codon usage optimized for expression in *S. cerevisiae*. This DNA was amplified using primers Atublip1 and AtubLip2 (SEQ ID NOs: 229 and 230, respectively) with Phusion DNA polymerase (New England Biolabs). The PCR product was transformed into yeast strain PNY1500 along with gapped plasmids pNAK33 (TEF1(M2) promoter), pNAK34 (TEF1(M4) promoter), and pNAK35 (TEF1(M6) promoter) (SEQ ID NOs: 231, 232, and 233, respectively). The transformation reactions were plated to SCD-His medium; colonies that appeared tested positive for expression of lipase activity on tributyrin plates. Plasmids were rescued from these isolates (Yeast Plasmid Miniprep Kit, Zymo Research) and transformed into *E. coli* DH5α and purified. Sequence analysis showed the expected nucleotide sequence of the *A. tubingensis* lipase transgenes. They were named pTVAN9, pTVAN4, and pTVAN10, respectively, for the TEF1(M2), TEF1(M4), and TEF1(M6) promoter variants, respectively ((SEQ ID NOs: 234, 235, and 236, respectively)).

The lipase-expressing strains PNY1055 (pTVAN9), PNY1056 (pTVAN4), and PNY1057 (pTVAN10) and the wildtype control strain (PNY827) were grown overnight in 50 mL SCD-His medium in a 250 mL vented-cap flask incubated at 30° C. and 250 rpm. The following morning, 22 mL of the culture was transferred to a 125 mL flask (unvented cap), with addition of 1.75 mL glucose (500 g/L), 2.5 mL 10×YEP (100 g/L yeast extract, 200 g/L peptone), and 0.313 mL isobutanol. A sample was taken, then 10.3 mL COFA and a sterile stir bar were added and the flasks returned to incubation. A sample (5 mL) was taken after 24 h for HPLC and GC analysis, and 1.75 mL glucose and 0.313 mL isobutanol were added. A second sample was taken after 96 h. Samples were analyzed as described above. The lipase-expressing strains were able to esterify isobutanol into FABE; at 96 h, the amount of FABE formed by these strains was more than ten-fold the amount formed by the control strain. As shown, the greatest amount of FABE formation was achieved by the strain with an intermediate-strength promoter driving lipase transcription.

TABLE 19

Measured amounts of isobutanol (iBuOH) and fatty acid isobutyl ester (FABE) in aqueous and organic phases of shake flask cultivations of the strain indicated.

| Strain | iBuOH in rxn, mg (AQ) | iBuOH in rxn, mg (ORG) | FABE in rxn, mg (ORG) |
|---|---|---|---|
| 24 h | | | |
| PNY1055 | 108 | 101 | 183 |
| PNY1056 | 98 | 83 | 272 |
| PNY1057 | 103 | 91 | 209 |
| PNY827 | 130 | 116 | 15 |
| 96 h | | | |
| PNY1055 | 171 | 159 | 649 |
| PNY1056 | 141 | 122 | 886 |
| PNY1057 | 163 | 144 | 700 |
| PNY827 | 237 | 232 | 52 |

Example 16

Genetic Abolition of the Glycosylation of Lipase Expressed in Yeast

N-glycosylation sequences matching to the consensus site of asparaginyl glycosylation, N-X-S/T (Drickamer K & Taylor M E (2006) Introduction to Glycobiology (2nd ed.). Oxford University Press, USA) were identified in LIP1 and CalB. LIP1 has two glycosylation sites (NIS at residue 146 and NNT at residue 167), and CalB has one (NDT at residue 99). These were altered by site-directed mutagenesis to substitute N with A in all cases (and to create the double mutant in LIP1) as follows.

Mutagenesis was carried out with the QuikChange Site-Directed Mutagenesis Kit (Strategene, La Jolla Calif.) according to the manufacturer's instructions, combining the following plasmids and primers:

| Protein, site | Primers | Primer SEQ ID NOs: | Plasmid | Plasmid SEQ ID NO: |
|---|---|---|---|---|
| CalB, N99 | Ca_NA99_for | 264 | pTVAN8 | 240 |
| | Ca_NA99_rev | 265 | | |
| LIP1, N146 | Cd_N146A_for | 266 | pNAK31 | 238 |
| | Cd_N146A_rev | 267 | | |
| LIP1, N167 | Cd_NA167_for | 268 | pNAK31 | 238 |
| | Cd_NA167_rev | 269 | | |
| LIP1/N167, N146 | Cd_N146A_for | 266 | pTVAN26 | 270 |
| | Cd_N146A_rev | 267 | | |

After amplification of the plasmid backbone with mutagenic primers using the thermostable polymerase provided with the kit, the DNA was digested with DpnI restriction endonuclease. The treated plasmids were transformed into *E. coli* XL1-Blue competent cells, and recovered using the Qiaprep Spin Miniprep Kit (Qiagen). Mutated clones were identified by DNA sequence analysis of the mutagenized plasmids. The plasmids were named pTVAN20, pTVAN25, pTVAN26, and pTVAN27, respectively. The plasmids (and control plasmids with the wildtype lipase genes) were transformed into the PNY1500 yeast strain.

SEQUENCE LISTING (278 sequences)

SEQ ID NO: 1 - DNA, 1029 bp, Candida antarctica
atgaagctactctctctgaccggtgtggctggtgtgcttgcgacttgcgttgcagccactcctttggtgaagcgtctaccttccggttcggaccctgccttttcgcagcccaagtcggtgctcgatgcgggtctgacctgccagggtgcttcgccatcctcggtctccaaacccatccttctcgtccccggaaccggcaccacaggtccacagtcgttcgactcgaactggatccccctctcaacgcagttgggttacacaccctgctggatctcacccccgccgttcatgctcaacgacacccaggtcaacacggagtacatggtcaacgccatcaccgcgctctacgctggttcgggcaacaacaagcttcccgtgcttacctggtcccagggtggtctggttgcacagtggggtctgaccttcttccccagtatcaggtccaaggtcgatcgacttatggcctttgcgcccgactacaagggcaccgtcctcgccggccctctcgatgcactcgcggttagtgcaccctccgtatggcagcaaaccaccggttcggcactcaccaccgcactccgaaacgcaggtggtctgacccagatcgtgcccaccaccaacctctactcggcgaccgacgagatcgttcagcctcaggtgtccaactcgccactcgactcatcctacctcttcaacggaaagaacgtccaggcacaggccgtgtgtgggccgctgttcgtcatcgaccatgcaggctcgctcacctcgcagttctcctacgtcgtcggtcgatccgccctgcgctccaccacgggccaggctcgtagtgcagactatggcattacggactgcaaccctcttcccgccaatgatctgactcccgagcaaaaggtcgccgcggctgcgctcctggcgccggcagctgcagccatcgtggcgggtccaaagcagaactgcgagcccgacctcatgccctacgcccgcccctttgcagtaggcaaaaggacctgctccggcatcgtcaccccctga

SEQ ID NO: 2 - protein, 342 aa, Candida antarctica
MKLLSLTGVAGVLATCVAATPLVKRLPSGSDPAFSQPKSVLDAGLTCQGASPSSVSKPILLVPGTGTTGPQSFDSNWIPLSTQLGYTPCWISPPPFMLNDTQVNTEYMVNAITALYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTP

SEQ ID NO: 3 - DNA, 1005 bp, Candida deformans
atgaagctttctaccattctccttacagcttgcgctactctggtggccgctctcccctcccccgtcactccttctgaggccgcagccctccagaagcgagtctacacttcaaccgagacttctcacattaaccaggactcctacaacttctttgagaagtacgcccgtctggccaacattggatactgtgttggtcccggtaccaagatcttcaagcccttcaactgtggtctccagtgtgctcacttccccaatgttgagctcatccaggagttccatgatcctcggctcgtctttgatgtctctggctacctcgctgtggaccacacctcgaagcagatctacctggtgatccgaggaacccattctcttgaggatgtcatcaccgacatccgaatcctgcaggctcctctcaccaactttgatttcgctgccaacatctcttctactgctacttgtgatgattgtcttgtccacaaaggtttcatcgagtcttacaacaacaccttcaaccagattggccccaagcttgactctgtgattgctgagcaccccgactacgagattgccgtcaccggtcactctctcggcggtgctgctgcccttctcttcggaatcaacctcaaggttaacggccacgatcctcttgttgttactctgggtcagcccattgtcggtaacgccggcttcgccaactgggtcgacagactcttctttggtgaggagaaccccgacgtttccaaggtgaccaaggaccgaaagctctaccgaatcactcatcgaggagatattgtgccccagatccccttctgggacggttaccagcactgttctggtgaggtcttcatcgactggccccttatccaccctcctctctccaacgttgtcacgtgtgagggccagagaaacaagcagtgctctgccggtaacactttgctccagcaagccaacgttcttggaaaccatctgcagtacttcgtcacccagggtgtctgtggtatttaa

SEQ ID NO: 4 - protein, 334 aa, Candida deformans
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAANISSTATCDDCLVHKGFIESYNNTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 5 - DNA, 876 bp, Thermomyces lanuginosus
atgaggagctcccttgtgctgttctttgtctctgcgtggacggccttggccagtcctattcgtcgagaggtctcgcaggatctgtttaaccagttcaatctctttgcacagtattctgcagccgcatactgcggaaaaaacaatgatgccccagctggtacaaacattacgtgcacgggaaatgcctgccccgaggtagagaaggcggatgcaacgtttctctactcgtttgaagactctggagtgggcgatgtcaccggcttccttgctctcgacaacacgaacaaattgatcgtcctctctttccgtggctctcgttccatagagaactggatcgggaatcttaacttcgacttgaaagaaataaatgacatttgctccggctgcaggggacatgacggcttcacttcgtcctggaggtctgtagccgatacgttaaggcagaaggtggaggatgctgtgagggagcatcccgactatcgcgtggtgtttaccggacatagcttgggtggtgcattggcaactgttgccggagcagacctgcgtggaaatgggtatgatatcgacgtgttttcatatggcgccccccgagtcggaaacagggcttttgcagaattcctgaccgtacagaccggcggaacactctaccgcattacccacaccaatgatattgtccctagactcccgccgcgcgaattcggttacagccattctagcccagagtactggatcaaatctggaacccttgtccccgtcacccgaaacgatatcgtgaagatagaaggcatcgatgccaccggcggcaataaccagcctaacattccggatatccctgcgcacctatggtacttcgggttaattgggacatgtctttag

SEQ ID NO: 6 - protein, 291 aa, Thermomyces lanuginosus
MRSSLVLFFVSAWTALASPIRREVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 7 - DNA, 1029 bp, Artificial sequence
  Coding sequence for Candida Antarctica lipase, codon-optimized for expression in S. cerevisiae
atgaagctactttccttgacaggtgtagctggcgtactggctacttgtgtcgccgcaacaccactagtcaaaagactaccatccggtagtgaccctgccttttctcaaccaaagtcagtcttggatgcaggtttaacatgccaaggtgcctcaccatctagtgtctcaaagcctatcttattggtacctggtactggtacaaccggaccacaatcattcgactctaattggatcccattatccactcaattaggctatactccatgttggatttcacctccaccattcatgcttaatgatactcaagtgaatactgagtacatggttaatgcaattactgccctatacgctggatccggaaacaataagttgccagtcttaacttggtcccaaggcggcttggttgcacaatggggactaacctttttccctagtataagatctaaagtggatagactgatggctttcgcaccagattacaagggaaccgttctagcaggccctcttgatgccctggcagtttcagcccctagtgtttggcaacaaacaactggttctgcattgacaaccgctttgagaaatgccggtgggttaacacaaatcgtgcctacaactaacttgtattctgccacagatgaaatcgttcaacctcaggtatctaattcaccactagactcttcatacctgtttaacggcaaaaacgtacaggcccaagctgtttgcggtccattgtttgtcatcgatcatgctgggtccttgacttctcaattctcttatgtggtgggtagatctgccttaagatctactacagggcaggctagatcagcagactacggcataaccgactgtaatccacttccagccaacgatttgacacctgaacagaaagtagccgctgcagctcttttagcaccagctgctgctgcaattgttgcaggtccaaaacaaaactgcgaaccagaccttatgccatacgctaggccttttgctgtgggtaaacgtacatgtagtggtatagttacaccataa

SEQ ID NO: 8 - DNA, 1005 bp, Artificial sequence
  Coding sequence for Candida Deformans lipase, codon-optimized for expression in S. cerevisiae
atgaagctatctacaattctgttgactgcctgcgctactttggtggccgctttgccttcacctgttacaccatcagaagctgctgctttacaaaagagagtgtatacatctactgaaacttcacacattaaccaagactcttacaactttttcgagaaatacgcaagattggccaacatcggttattgtgttggcccaggcactaagattttcaaacctttcaattgtggcttacaatgtgcccattttccaaatgtggaattgattcaagagttccacgacccaagacttgtatttgacgtttccggttatcttgcagttgatcatacatccaaacaaatctaccttgtcataagaggtacccactcattagaagatgtaatcactgacattcgtatccttcaggctccattgaccaactttgattttgcagccaatatcagttcaacagccacttgtgatgactgtttagtccataaaggctttatcgaatcttacaacaatacattcaaccagattggtccaaagttagattctgtgatagcagagcacccagattacgaaattgcagttaccggtcattcactgggtggtgctgcagccctattgttcggaatcaacttgaaagtaaacggtcatgatccactagttgtcaccctaggccaacctatagtgggaaatgctggattcgctaattgggtcgataggttgtttttcggggaagagaatcctgatgtatccaaggtaacaaaagatagaaaactatacaggatcacacatagaggggacattgtgcctcaaatacctttttgggatggttatcaacattgttctggtgaagtctttatcgattggccactgatacatcctccactgtctaatgttgttacatgcgaaggacagagaaacaagcaatgcagtgcaggaaatacactgctacagcaggctaatgtcttaggaaatcacttgcaatactttgtaacacaaggggtttgcggtatctaa

SEQ ID NO: 9 - DNA, 876 bp, Artificial sequence
  Coding sequence for Thermomyces lanuginosus lipase, codon-optimized for expression in S. cerevisiae
atgagatcatcactagtgttgtttttcgtaagtgcttggactgcattggcttctccaattagaagagaagtttcccaagacctgtttaaccaattcaatctttttgctcaatactctgcagccgcatactgtggtaaaaacaatgatgccccagcagggacaaacattacatgtactggaaacgcctgccctgaagtagaaaaggctgacgccacctttttgtactctttcgaagattcaggtgttggcgatgtgacaggttttctagctttggacaacaccaacaaattgatcgttctgtctttcaggggttctagatctatcgaaaattggattggcaacctcaattttgatctgaaagagatcaatgatatatgctcagggtgtagaggacatgatggcttcactagttcctggagatcagtcgcagatacgttgcgtcaaaaggtcgaggatgctgttcgggaacatccagattacagagtagtgttcacagggcactccttaggtggtgccttagctactgttgccggtgctgaccttagaggcaatggttacgacattgatgtttttagctatggcgcacctagggttggaaatcgtgcgtttgctgaatttctcacagtgcagacaggaggcacattatacagaattactcatactaatgatatagtcccaaggttaccaccacgggagttcggttacagtcactcttctccagaatattggatcaaatcagggactctagtccctgttacccgtaacgacatcgtaaagattgaaggtatcgatgcaacaggtggaaataatcaacctaatatacctgacatcccagcgcatttgtggtattttggtttaataggaacatgtctttaa

SEQ ID NO: 10 - DNA, 74 bp, Artificial sequence
  Primer 1
ttgctcgttagagagaaagcatagcaatctaatctaagttccagctgaggatgaagctatctacaattctgttg

SEQ ID NO: 11 - DNA, 71 bp, Artificial sequence
  Primer 2
ggggagggcgtgaatgtaagcgtgacataactaattacatgattaattaattagataccgcaaaccccttg

SEQ ID NO: 12 - DNA, 77 bp, Artificial sequence
  Primer 3
ttgctcgttagagagaaagcatagcaatctaatctaagttccagctgaggatgagatcatcactagtgttgtttttc

SEQ ID NO: 13 - DNA, 73 bp, Artificial sequence
  Primer 4
ggggagggcgtgaatgtaagcgtgacataactaattacatgattaattaattaaagacatgttcctattaaac

SEQ ID NO: 14 - DNA, 70 bp, Artificial sequence
  Primer CALBL_gap_for
ttgctcgttagagagaaagcatagcaatctaatctaagttccagctgaggatgaagctactttccttgac

SEQ ID NO: 15 - DNA, 76 bp, Artificial sequence
  CALBL_gap_rev
ggggagggcgtgaatgtaagcgtgacataactaattacatgattaattaattatggtgtaactataccactacatg

SEQ ID NO: 16 - DNA, 16 bp, Artificial sequence
  Primer 7-M13R
aacagctatgaccatg

SEQ ID NO: 17 - DNA, 20 bp, Artificial sequence
  Primer 8-T7
taatacgactcactataggg

SEQ ID NO: 18 - DNA, 22 bp, Artificial sequence
  Primer oBP440
tacgtacggaccaatcgaagtg

SEQ ID NO: 19 - DNA, 49 bp, Artificial sequence
  Primer oBP441
aattcgtttgagtacactactaatggctttgttggcaatatgtttttgc

SEQ ID NO: 20 - DNA, 49 bp, Artificial sequence
  Primer oBP442
atatagcaaaaacatattgccaacaaagccattagtagtgtactcaaac

SEQ ID NO: 21 - DNA, 49 bp, Artificial sequence
  oBP443
tatggaccctgaaaccacagccacattcttgttatttataaaaagacac

SEQ ID NO: 22 - DNA, 49 bp, Artificial sequence
  Primer oBP444
ctcccgtgtctttttataaataacaagaatgtggctgtggtttcagggt

SEQ ID NO: 23 - DNA, 49 bp, Artificial sequence
  Primer oBP445
taccgtaggcgtccttaggaaagatagaaggccatgaagctttttcttt

SEQ ID NO: 24 - DNA, 49 bp, Artificial sequence
  Primer oBP446
attggaaagaaaaagcttcatggccttctatctttcctaaggacgccta

SEQ ID NO: 25 - DNA, 4586 bp, Artificial sequence
  pLA54 template DNA
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 26 - DNA, 80 bp, Artificial sequence
  Primer BK505
ttccggtttctttgaaatttttttgattcggtaatctccgagcagaaggagcattgcggattacgtattctaatgttcag

SEQ ID NO: 27 - DNA, 81 bp, Artificial sequence
  Primer BK506
gggtaataactgatataattaaattgaagctctaatttgtgagtttagtacaccttggctaactcgttgtatcatcactgg

SEQ ID NO: 28 - DNA, 38 bp, Artificial sequence
  Primer LA468
gcctcgagttttaatgttacttctcttgcagttaggga

SEQ ID NO: 29 - DNA, 31 bp, Artificial sequence
  Primer LA492
gctaaattcgagtgaaacacaggaagaccag

SEQ ID NO: 30 - DNA, 24 bp, Artificial sequence
  Primer oBP452
ttctcgacgtgggcctttttcttg

SEQ ID NO: 31 - DNA, 49 bp, Artificial sequence
  Primer oBP453
tgcagctttaaataatcggtgtcactactttgccttcgtttatcttgcc

SEQ ID NO: 32 - DNA, 49 bp, Artificial sequence
  Primer oBP454
gagcaggcaagataaacgaaggcaaagtagtgacaccgattatttaaag

SEQ ID NO: 33 - DNA, 49 bp, Artificial sequence
  Primer oBP455
tatggaccctgaaaccacagccacattgtaaccaccacgacggttgttg

SEQ ID NO: 34 - DNA, 49 bp, Artificial sequence
  Primer oBP456
tttagcaacaaccgtcgtggtggttacaatgtggctgtggtttcagggt

SEQ ID NO: 35 - DNA, 49 bp, Artificial sequence
  Primer oBP457
ccagaaaccctatacctgtgtggacgtaaggccatgaagctttttcttt

SEQ ID NO: 36 - DNA, 49 bp, Artificial sequence
  Primer oBP458
attggaaagaaaaagcttcatggccttacgtccacacaggtatagggtt

SEQ ID NO: 37 - DNA, 22 bp, Artificial sequence
  Primer oBP459
cataagaacacctttggtggag

SEQ ID NO: 38 - DNA, 22 bp, Artificial sequence
  Primer oBP460
aggattatcattcataagtttc

SEQ ID NO: 39 - DNA, 23 bp, Artificial sequence
  Primer oBP461
ttcttggagctgggacatgtttg

SEQ ID NO: 40 - DNA, 7523 bp, Artificial sequence
  pRS423::PGAL1-cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 41 - DNA, 22 bp, Artificial sequence
  Primer oBP450
tgatgatatttcataaataatg

SEQ ID NO: 42 - DNA, 23 bp, Artificial sequence
  Primer oBP451
atgcgtccatctttacagtcctg

SEQ ID NO: 43 - DNA, 9593 bp, Artificial sequence
  pYZ090deltaAlsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 44 - DNA, 12896 bp, Artificial sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 45 - DNA, 7448 bp, Artificial sequence
  pNAK10
cctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaacttagataccgcaaaccccttgtgttacaaagtattgcaagtgatttcctaagacattagcctgctgtagcagtgtatttcctgcactgcattgcttgtttctctgtccttcgcatgtaacaacattagacagtggaggatgtatcagtggccaatcgataaagacttcaccagaacaatgttgataaccatcccaaaaaggtatttgaggcacaatgtcccctctatgtgtgatcctgtatagttttctatcttttgttaccttggatacatcaggattctcttccccgaaaaacaacctatcgacccaattagcgaatccagcatttcccactataggttggcctagggtgacaactagtggatcatgaccgtttactttcaagttgattccgaacaatagggctgcagcaccacccagtgaatgaccggtaactgcaatttcgtaatctgggtgctctgctatcacagaatctaactttggaccaatctggttgaatgtattgttgtaagattcgataaagcctttatggactaaacagtcatcacaagtggctgttgaactgatattggctgcaaaatcaaagttggtcaatggagcctgaaggatacgaatgtcagtgattacatcttctaatgagtgggtacctcttatgacaaggtagatttgtttggatgtatgatcaactgcaagataaccggaaacgtcaaatacaagtcttgggtcgtggaactcttgaatcaattccacatttggaaaatgggcacattgtaagccacaattgaaaggtttgaaaatcttagtgcctgggccaacacaataaccgatgttggccaatcttgcgtatttctcgaaaaagttgtaagagtcttggttaatgtgtgaagtttcagtagatgtatacactctcttttgtaaagcagcagcttctgatggtgtaacaggtgaaggcaaagcggccaccaaagtagcgcaggcagtcaacagaattgtagatagcttcat

SEQ ID NO: 46 - DNA, 1029 bp, Artificial sequence
  Coding sequence for Candida antarctica variant N99A, codon-optimized for expression in S. cerevisiae
atgaagctactttccttgacaggtgtagctggcgtactggctacttgtgtcgccgcaacaccactagtcaaaagactaccatccggtagtgaccctgccttttctcaaccaaagtcagtcttggatgcaggtttaacatgccaaggtgcctcaccatctagtgtctcaaagcctatcttattggtacctggtactggtacaaccggaccacaatcattcgactctaattggatcccattatccactcaattaggctatactccatgttggatttcacctccaccattcatgcttgctgatactcaagtgaatactgagtacatggttaatgcaattactgccctatacgctggatccggaaacaataagttgccagtcttaacttggtcccaaggcggcttggttgcacaatggggactaacctttttccctagtataagatctaaagtggatagactgatggctttcgcaccagattacaagggaaccgttctagcaggccctcttgatgccctggcagtttcagcccctagtgtttggcaacaaacaactggttctgcattgacaaccgctttgagaaatgccggtgggttaacacaaatcgtgcctacaactaacttgtattctgccacagatgaaatcgttcaacctcaggtatctaattcaccactagactcttcatacctgtttaacggcaaaaacgtacaggcccaagctgtttgcggtccattgtttgtcatcgatcatgctgggtccttgacttctcaattctcttatgtggtgggtagatctgccttaagatctactacagggcaggctagatcagcagactacggcataaccgactgtaatccacttccagccaacgatttgacacctgaacagaaagtagccgctgcagctcttttagcaccagctgctgctgcaattgttgcaggtccaaaacaaaactgcgaaccagaccttatgccatacgctaggccttttgctgtgggtaaacgtacatgtagtggtatagttacaccataa

SEQ ID NO: 47 - protein, 342 aa, Artificial sequence
  Candida antarctica lipase variant-N99A
MKLLSLTGVAGVLATCVAATPLVKRLPSGSDPAFSQPKSVLDAGLTCQGASPSSVSKPILLVPGTGTTGPQSFDSNWIPLSTQLGYTPCWISPPPFMLADTQVNTEYMVNAITALYAGSGNNKLPVLTWSQGGLVAQWGLTFFPSIRSKVDRLMAFAPDYKGTVLAGPLDALAVSAPSVWQQTTGSALTTALRNAGGLTQIVPTTNLYSATDEIVQPQVSNSPLDSSYLFNGKNVQAQAVCGPLFVIDHAGSLTSQFSYVVGRSALRSTTGQARSADYGITDCNPLPANDLTPEQKVAAAALLAPAAAAIVAGPKQNCEPDLMPYARPFAVGKRTCSGIVTP

SEQ ID NO: 48 - DNA, 1005 bp, Artificial sequence
  Coding sequence for Candida deformans variant N146A, codon-optimized for expression in S. cerevisiae
atgaagctatctacaattctgttgactgcctgcgctactttggtggccgctttgccttcacctgttacaccatcagaagctgctgctttacaaaagagagtgtatacatctactgaaacttcacacattaaccaagactcttacaactttttcgagaaatacgcaagattggccaacatcggttattgtgttggcccaggcactaagattttcaaacctttcaattgtggcttacaatgtgcccattttccaaatgtggaattgattcaagagttccacgacccaagacttgtatttgacgtttccggttatcttgcagttgatcatacatccaaacaaatctaccttgtcataagaggtacccactcattagaagatgtaatcactgacattcgtatccttcaggctccattgaccaactttgattttgcagccgctatcagttcaacagccacttgtgatgactgtttagtccataaaggctttatcgaatcttacaacaatacattcaaccagattggtccaaagttagattctgtgatagcagagcacccagattacgaaattgcagttaccggtcattcactgggtggtgctgcagccctattgttcggaatcaacttgaaagtaaacggtcatgatccactagttgtcaccctaggccaacctatagtgggaaatgctggattcgctaattgggtcgataggttgtttttcggggaagagaatcctgatgtatccaaggtaacaaaagatagaaaactatacaggatcacacatagaggggacattgtgcctcaaatacctttttgggatggttatcaacattgttctggtgaagtctttatcgattggccactgatacatcctccactgtctaatgttgttacatgcgaaggacagagaaacaagcaatgcagtgcaggaaatacactgctacagcaggctaatgtcttaggaaatcacttgcaatactttgtaacacaaggggtttgcggtatctaa

SEQ ID NO: 49 - protein, 334 aa, Artificial sequence
  Candida deformans lipase variant-N146A
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAAAISSTATCDDCLVHKGFIESYNNTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 50 - DNA, 1005 bp, Artificial sequence
  Coding sequence for Candida deformans variant N167A, codon-optimized for expression in S. cerevisiae
atgaagctatctacaattctgttgactgcctgcgctactttggtggccgctttgccttcacctgttacaccatcagaagctgctgctttacaaaagagagtgtatacatctactgaaacttcacacattaaccaagactcttacaactttttcgagaaatacgcaagattggccaacatcggttattgtgttggcccaggcactaagattttcaaacctttcaattgtggcttacaatgtgcccattttccaaatgtggaattgattcaagagttccacgacccaagacttgtatttgacgtttccggttatcttgcagttgatcatacatccaaacaaatctaccttgtcataagaggtacccactcattagaagatgtaatcactgacattcgtatccttcaggctccattgaccaactttgattttgcagccaatatcagttcaacagccacttgtgatgactgtttagtccataaaggctttatcgaatcttacagctatacattcaaccagattggtccaaagttagattctgtgatagcagagcacccagattacgaaattgcagttaccggtcattcactgggtggtgctgcagccctattgttcggaatcaacttgaaagtaaacggtcatgatccactagttgtcaccctaggccaacctatagtgggaaatgctggattcgctaattgggtcgataggttgtttttcggggaagagaatcctgatgtatccaaggtaacaaaagatagaaaactatacaggatcacacatagaggggacattgtgcctcaaatacctttttgggatggttatcaacattgttctggtgaagtctttatcgattggccactgatacatcctccactgtctaatgttgttacatgcgaaggacagagaaacaagcaatgcagtgcaggaaatacactgctacagcaggctaatgtcttaggaaatcacttgcaatactttgtaacacaaggggtttgcggtatctaa

SEQ ID NO: 51 - protein, 334 aa, Artificial sequence
  Candida deformans lipase variant-N167A
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAANISSTATCDDCLVHKGFIESYANTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 52 - DNA, 1005 bp, Artificial sequence
  Coding sequence for Candida deformans variant N146A/N167A, codon-optimized for expression in S. cerevisiae
atgaagctatctacaattctgttgactgcctgcgctactttggtggccgctttgccttcacctgttacaccatcagaagctgctgctttacaaaagagagtgtatacatctactgaaacttcacacattaaccaagactcttacaactttttcgagaaatacgcaagattggccaacatcggttattgtgttggcccaggcactaagattttcaaacctttcaattgtggcttacaatgtgcccattttccaaatgtggaattgattcaagagttccacgacccaagacttgtatttgacgtttccggttatcttgcagttgatcatacatccaaacaaatctaccttgtcataagaggtacccactcattagaagatgtaatcactgacattcgtatccttcaggctccattgaccaactttgattttgcagccgctatcagttcaacagccacttgtgatgactgtttagtccataaaggctttatcgaatcttacagctatacattcaaccagattggtccaaagttagattctgtgatagcagagcacccagattacgaaattgcagttaccggtcattcactgggtggtgctgcagccctattgttcggaatcaacttgaaagtaaacggtcatgatccactagttgtcaccctaggccaacctatagtgggaaatgctggattcgctaattgggtcgataggttgtttttcggggaagagaatcctgatgtatccaaggtaacaaaagatagaaaactatacaggatcacacatagaggggacattgtgcctcaaatacctttttgggatggttatcaacattgttctggtgaagtctttatcgattggccactgatacatcctccactgtctaatgttgttacatgcgaaggacagagaaacaagcaatgcagtgcaggaaatacactgctacagcaggctaatgtcttaggaaatcacttgcaatactttgtaacacaaggggtttgcggtatctaa

SEQ ID NO: 53 - protein, 334 aa, Artificial sequence
  Candida deformans lipase variant N146A/N167A
MKLSTILLTACATLVAALPSPVTPSEAAALQKRVYTSTETSHINQDSYNFFEKYARLANIGYCVGPGTKIFKPFNCGLQCAHFPNVELIQEFHDPRLVFDVSGYLAVDHTSKQIYLVIRGTHSLEDVITDIRILQAPLTNFDFAAAISSTATCDDCLVHKGFIESYANTFNQIGPKLDSVIAEHPDYEIAVTGHSLGGAAALLFGINLKVNGHDPLVVTLGQPIVGNAGFANWVDRLFFGEENPDVSKVTKDRKLYRITHRGDIVPQIPFWDGYQHCSGEVFIDWPLIHPPLSNVVTCEGQRNKQCSAGNTLLQQANVLGNHLQYFVTQGVCGI

SEQ ID NO: 54 - DNA, 876 bp, Artificial sequence
  Coding sequence for Thermomyces lanuginosus variant N55A, codon-optimized for expression in S. cerevisiae
atgagatcatcactagtgttgtttttcgtaagtgcttggactgcattggcttctccaattagaagagaagtttcccaagacctgtttaaccaattcaatctttttgctcaatactctgcagccgcatactgtggtaaaaacaatgatgccccagcagggacagctattacatgtactggaaacgcctgccctgaagtagaaaaggctgacgccacctttttgtactctttcgaagattcaggtgttggcgatgtgacaggttttctagctttggacaacaccaacaaattgatcgttctgtctttcaggggttctagatctatcgaaaattggattggcaacctcaattttgatctgaaagagatcaatgatatatgctcagggtgtagaggacatgatggcttcactagttcctggagatcagtcgcagatacgttgcgtcaaaaggtcgaggatgctgttcgggaacatccagattacagagtagtgttcacagggcactccttaggtggtgccttagctactgttgccggtgctgaccttagaggcaatggttacgacattgatgtttttagctatggcgcacctagggttggaaatcgtgcgtttgctgaatttctcacagtgcagacaggaggcacattatacagaattactcatactaatgatatagtcccaaggttaccaccacgggagttcggttacagtcactcttctccagaatattggatcaaatcagggactctagtccctgttacccgtaacgacatcgtaaagattgaaggtatcgatgcaacaggtggaaataatcaacctaatatacctgacatcccagcgcatttgtggtattttggtttaataggaacatgtctttaa

SEQ ID NO: 55 - protein, 291 aa, Artificial sequence
  Thermomyces lanuginosus variant N55A
MRSSLVLFFVSAWTALASPIRREVSQDLFNQFNLFAQYSAAAYCGKNNDAPAGTAITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHSLGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 56 - DNA, 21 bp, Artificial sequence
  Primer oBP447
ttattgtttggcatttgtagc

SEQ ID NO: 57 - DNA, 22 bp, Artificial sequence
  Primer oBP448
ccaagcatctcataaacctatg

SEQ ID NO: 58 - DNA, 22 bp, Artificial sequence
  Primer oBP449
tgtgcagatgcagatgtgagac

SEQ ID NO: 59 - DNA, 17 bp, Artificial sequence
  oBP554
agttattgataccgtac

SEQ ID NO: 60 - DNA, 19 bp, Artificial sequence
  Primer oBP555
cgagataccgtaggcgtcc

SEQ ID NO: 61 - DNA, 24 bp, Artificial sequence
  Primer oBP513
ttatgtatgctcttctgacttttc

SEQ ID NO: 62 - DNA, 49 bp, Artificial sequence
  Primer oBP515
aataattagagattaaatcgctcattttttgccagtttcttcaggcttc

SEQ ID NO: 63 - DNA, 49 bp, Artificial sequence
  Primer oBP516
agcctgaagaaactggcaaaaaatgagcgatttaatctctaattattag

SEQ ID NO: 64 - DNA, 49 bp, Artificial sequence
  Primer oBP517
tatggaccctgaaaccacagccacatttttcaatcattggagcaatcat

SEQ ID NO: 65 - DNA, 49 bp, Artificial sequence
  Primer oBP518
taaaatgattgctccaatgattgaaaaatgtggctgtggtttcagggtc

SEQ ID NO: 66 - DNA, 49 bp, Artificial sequence
  Primer oBP519
accgtaggtgttgtttgggaaagtggaaggccatgaagctttttctttc

SEQ ID NO: 67 - DNA, 49 bp, Artificial sequence
  Primer oBP520
ttggaaagaaaaagcttcatggccttccactttcccaaacaacacctac

SEQ ID NO: 68 - DNA, 23 bp, Artificial sequence
  Primer oBP521
ttattgcttagcgttggtagcag

SEQ ID NO: 69 - DNA, 21 bp, Artificial sequence
  Primer oBP511
tttttggtggttccggcttcc

SEQ ID NO: 70 - DNA, 22 bp, Artificial sequence
  Primer oBP512
aaagttggcatagcggaaactt

SEQ ID NO: 71 - DNA, 16 bp, Artificial sequence
  Primer oBP550
gtcattgacaccatct

SEQ ID NO: 72 - DNA, 19 bp, Artificial sequence
  Primer oBP551
agagataccgtaggtgttg

SEQ ID NO: 73 - DNA, 33 bp, Artificial sequence
  Primer oBP530
aattggcgcgccatgaaagctctggtttatcac

SEQ ID NO: 74 - DNA, 49 bp, Artificial sequence
  Primer oBP531
tgaatcatgagttttatgttaattagctcaggcagcgcctgcgttcgag

SEQ ID NO: 75 - DNA, 49 bp, Artificial sequence
  Primer oBP532
atcctctcgaacgcaggcgctgcctgagctaattaacataaaactcatg

SEQ ID NO: 76 - DNA, 34 bp, Artificial sequence
  Primer oBP533
aattgtttaaacaagtaaataaattaatcagcat

SEQ ID NO: 77 - DNA, 49 bp, Artificial sequence
  Primer oBP536
acacaatacaataacaagaagaacaaaatgaaagctctggtttatcacg

SEQ ID NO: 78 - DNA, 49 bp, Artificial sequence
  Primer oBP546
agcgtatacatctgttgggaaagtagaaggccatgaagctttttctttc

SEQ ID NO: 79 - DNA, 49 bp, Artificial sequence
  Primer oBP547
ttggaaagaaaaagcttcatggccttctactttcccaacagatgtatac

SEQ ID NO: 80 - DNA, 22 bp, Artificial sequence
  Primer oBP539
ttattgtttagcgttagtagcg

SEQ ID NO: 81 - DNA, 72 bp, Artificial sequence
  Primer oBP542
cataatcaatctcaaagagaacaacacaatacaataacaagaagaacaaaatgaaagctctggtttatcacg

SEQ ID NO: 82 - DNA, 21 bp, Artificial sequence
  Primer oBP540
taggcataatcaccgaagaag

SEQ ID NO: 83 - DNA, 21 bp, Artificial sequence
  Primer oBP541
aaaatggtaagcagctgaaag

SEQ ID NO: 84 - DNA, 17 bp, Artificial sequence
  Primer oBP552
agttgttagaactgttg

SEQ ID NO: 85 - DNA, 19 bp, Artificial sequence
  Primer oBP553
gacgatagcgtatacatct

SEQ ID NO: 86 - DNA, 22 bp, Artificial sequence
  Primer oBP582
cttagcctctagccatagccat

SEQ ID NO: 87 - DNA, 23 bp, Artificial sequence
  AA270
ttagttttgctggccgcatcttc

SEQ ID NO: 88 - DNA, 21 bp, Artificial sequence
  oBP591
cccattaatatactattgaga

SEQ ID NO: 89 - DNA, 57 bp, Artificial sequence
  oBP438
aattggatccggcgcgccgtttaaacggccggccaatgtggctgtggtttcagggtc

SEQ ID NO: 90 - DNA, 49 bp, Artificial sequence
  Primer oBP439
aatttctagattaattaagcggccgcaaggccatgaagctttttctttc

SEQ ID NO: 91 - DNA, 21 bp, Artificial sequence
  Primer oBP264
tcggtgcgggcctcttcgcta

SEQ ID NO: 92 - DNA, 21 bp, Artificial sequence
  Primer oBP265
aatgtgagttagctcactcat

SEQ ID NO: 93 - DNA, 15456 bp, Artificial sequence
  pLH468-sadB
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 94 - DNA, 2686 bp, Artificial sequence
  pUC19
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 95 - DNA, 90 bp, Artificial sequence
  Primer LA512
gtattttggtagattcaattctctttccctttccttttccttcgctccccttccttatcagcattgcggattacgtattctaatgttcag

SEQ ID NO: 96 - DNA, 90 bp, Artificial sequence
  Primer LA513
ttggttgggggaaaaagaggcaacaggaaagatcagagggggagggggggggagagtgtcaccttggctaactcgttgtatcatcactgg

SEQ ID NO: 97 - DNA, 29 bp, Artificial sequence
  primer FBAp-F
ctacaatcaacagatcgcttcaattacgc

SEQ ID NO: 98 - skipped

SEQ ID NO: 99 - DNA, 22 bp, Artificial sequence
  Primer oBP594
agctgtctcgtgttgtgggttt

SEQ ID NO: 100 - DNA, 7318 bp, Artificial sequence
  pTVAN2
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 101 - DNA, 7471 bp, Artificial sequence
  pTVAN3
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattatggtgtaactataccactacatgtacgtttacccacagcaaaaggcctagcgtatggcataaggtctggttcgcagttttgttttggacctgcaacaattgcagcagcagctggtgctaaaagagctgcagcggctactttctgttcaggtgtcaaatcgttggctggaagtggattacagtcggttatgccgtagtctgctgatctagcctgccctgtagtagatcttaaggcagatctacccaccacataagagaattgagaagtcaaggacccagcatgatcgatgacaaacaatggaccgcaaacagcttgggcctgtacgtttttgccgttaaacaggtatgaagagtctagtggtgaattagatacctgaggttgaacgatttcatctgtggcagaatacaagttagttgtaggcacgatttgtgttaacccaccggcatttctcaaagcggttgtcaatgcagaaccagttgtttgttgccaaacactaggggctgaaactgccagggcatcaagagggcctgctagaacggttcccttgtaatctggtgcgaaagccatcagtctatccactttagatcttatactagggaaaaaggttagtccccattgtgcaaccaagccgccttgggaccaagttaagactggcaacttattgtttccggatccagcgtatagggcagtaattgcattaaccatgtactcagtattcacttgagtatcattaagcatgaatggtggaggtgaaatccaacatggagtatagcctaattgagtggataatgggatccaattagagtcgaatgattgtggtccggttgtaccagtaccaggtaccaataagataggctttgagacactagatggtgaggcaccttggcatgttaaacctgcatccaagactgactttggttgagaaaaggcagggtcactaccggatggtagtcttttgactagtggtgttgcggcgacacaagtagccagtacgccagctacacctgtcaaggaaagtagcttcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 102 - DNA, 49 bp, Artificial sequence
  Primer oBP595
cttaataatagaacaatatcatcctttacgggcatcttatagtgtcgtt

SEQ ID NO: 103 - DNA, 49 bp, Artificial sequence
  Primer oBP596
gcgccaacgacactataagatgcccgtaaaggatgatattgttctatta

SEQ ID NO: 104 - DNA, 49 bp, Artificial sequence
  Primer oBP597
tatggaccctgaaaccacagccacattgcaacgacgacaatgccaaacc

SEQ ID NO: 105 - DNA, 49 bp, Artificial sequence
  Primer oBP598
tccttggtttggcattgtcgtcgttgcaatgtggctgtggtttcagggt

SEQ ID NO: 106 - DNA, 49 bp, Artificial sequence
  Primer oBP599
atcctctcgcggagtccctgttcagtaaaggccatgaagctttttcttt

SEQ ID NO: 107 - DNA, 49 bp, Artificial sequence
  Primer oBP600
attggaaagaaaaagcttcatggcctttactgaacagggactccgcgag

SEQ ID NO: 108 - DNA, 22 bp, Artificial sequence
  Primer oBP601
tcataccacaatcttagaccat

SEQ ID NO: 109 - DNA, 21 bp, Artificial sequence
  Primer oBP602
tgttcaaacccctaaccaacc

SEQ ID NO: 110 - DNA, 22 bp, Artificial sequence
  Primer oBP603
tgttcccacaatctattaccta

SEQ ID NO: 111 - DNA, 21 bp, Artificial sequence
  Primer oBP605
tactgaacagggactccgcga

SEQ ID NO: 112 - DNA, 21 bp, Artificial sequence
  Primer oBP606
tcataccacaatcttagacca

SEQ ID NO: 113 - DNA, 34 bp, Artificial sequence
  Primer oBP562
aattgtttaaacatgtatacagtaggtgactatc

SEQ ID NO: 114 - DNA, 49 bp, Artificial sequence
  Primer oBP563
aatcataaatcataagaaattcgcttatcagctcttgttttgttctgca

SEQ ID NO: 115 - DNA, 49 bp, Artificial sequence
  Primer oBP564
ttatttgcagaacaaaacaagagctgataagcgaatttcttatgattta

SEQ ID NO: 116 - DNA, 34 bp, Artificial sequence
  Primer oBP565
aattggccggccaaaaaaagcatgcacgtataca

SEQ ID NO: 117 - DNA, 32 bp, Artificial sequence
  Primer oBP505
aattgagctcactgtagccctagacttgatag

SEQ ID NO: 118 - DNA, 35 bp, Artificial sequence
  Primer oBP506
aattggcgcgcctgtatatgagatagttgattgta

SEQ ID NO: 119 - DNA, 35 bp, Artificial sequence
  Primer oBP507
aattttaattaagtctaggttctttggctgttcaa

SEQ ID NO: 120 - DNA, 33 bp, Artificial sequence
  Primer oBP508
aattgtcgactttagaagtgtcaacaacgtatc

SEQ ID NO: 121 - DNA, 34 bp, Artificial sequence
  Primer oBP674
aattggcgcgccaattaccgtcgctcgtgatttg

SEQ ID NO: 122 - DNA, 34 bp, Artificial sequence
  Primer oBP675
aattgtttaaacttgaatatgtattacttggtta

SEQ ID NO: 123 - DNA, 22 bp, Artificial sequence
  Primer oBP495
ggagatatacaatagaacagat

SEQ ID NO: 124 - DNA, 22 bp, Artificial sequence
  Primer oBP496
tagcaatggggtttttttcagt

SEQ ID NO: 125 - DNA, 20 bp, Artificial sequence
  Primer N98SeqF1
cgtgttagtcacatcaggac

SEQ ID NO: 126 - DNA, 22 bp, Artificial sequence
  Primer N99SeqR2
catcgactgcattacgcaactc

SEQ ID NO: 127 - DNA, 20 bp, Artificial sequence
  Primer N98SeqF4
ggtttctgtctctggtgacg

SEQ ID NO: 128 - DNA, 30 bp, Artificial sequence
  Primer N1111
tatttgtatcgaggtgtctagtcttctatt

SEQ ID NO: 129 - DNA, 15539 bp, Artificial sequence
  pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 130 - DNA, 8366 bp, Artificial sequence
  pRS316-UAS(PGK1)-PFBA1-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 131 - DNA, 38 bp, Artificial sequence; identical to SEQ ID NO: 28
  Primer BK468

SEQ ID NO: 132 - DNA, 34 bp, Artificial sequence
  Primer AK11-24
ctaggcgcgccatagcttcagaatgtttctactc

SEQ ID NO: 133 - DNA, 32 bp, Artificial sequence
  Primer AK11-25
ctaggcgcgccccgcaaattaaagccttcgag

SEQ ID NO: 134 - DNA, 21 bp, Artificial sequence
  Primer AK11-26
gacaacctgaagtctaggtcc

SEQ ID NO: 135 - DNA, 23 bp, Artificial sequence
  Primer AK11-27
gtatgctgtgcttgggtgttttg

SEQ ID NO: 136 - DNA, 40 bp, Artificial sequence
  Primer oBP691
aattggatccgcgatcgcgacgttctctccgttgttcaaa

SEQ ID NO: 137 - DNA, 34 bp, Artificial sequence
  Primer oBP696
aattttaattaaacgggcatcttatagtgtcgtt

SEQ ID NO: 138 - DNA, 22 bp, Artificial sequence
  Primer oBP730
ttgctccaaagagatgtcttta

SEQ ID NO: 139 - DNA, 22 bp, Artificial sequence
  Primer oBP731
tgttcccacaatctattaccta

SEQ ID NO: 140 - DNA, 41 bp, Artificial sequence
  Primer TlLipNAfor
gatgccccagcagggacagctattacatgtactggaaacgc

SEQ ID NO: 141 - DNA, 41 bp, Artificial sequence
  Primer TlLipNArev
gcgtttccagtacatgtaatagctgtccctgctggggcatc

SEQ ID NO: 142 - DNA, 32 bp, Artificial sequence
  Primer oBP622
aattggtaccccaaaaggaatattgggtcaga

SEQ ID NO: 143 - DNA, 49 bp, Artificial sequence
  Primer oBP623
ccattgtttaaacggcgcgccggatcctttgcgaaaccctatgctctgt

SEQ ID NO: 144 - DNA, 49 bp, Artificial sequence
  Primer oBP624
gcaaaggatccggcgcgccgtttaaacaatggaaggtcgggatgagcat

SEQ ID NO: 145-152 - skipped (8 entries)

SEQ ID NO: 153 - DNA, 30 bp, Artificial sequence
  N1110
gcgatttaatctctaattattagttaaagt

SEQ ID NO: 154 - DNA, 22 bp, Artificial sequence
  Primer N160SeqF5
cctgaagtctaggtccctattt

SEQ ID NO: 155 - DNA, 7589 bp, Artificial sequence
  pUC19-kan::pdc1::FBA-alsS::TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 156 - DNA, 10934 bp, Artificial sequence
  pRS423::TEF(M4)-xpk1+ENO1-eutD
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 157 - DNA, 9220 bp, Artificial sequence
  pUC19-URA3::pdc1::TEF(M4)-xpk1::kan
ccgcattgcggattacgtattctaatgttcagataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatccagtgatgatacaacgagttagccaaggtgggggatcctctagagtcttaaggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttttatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaa

SEQ ID NO: 158 - DNA, 19 bp, Artificial sequence
  Primer N160SeqR5
tgagcccgaaagagaggat

SEQ ID NO: 159 - DNA, 38 bp, Artificial sequence
  Primer N821
cgcccgggccactagtcagatgccgcgggcacttgagc

SEQ ID NO: 160 - DNA, 44 bp, Artificial sequence
  Primer N822
cgcctcagctttgatttagtgtttgtgtgttgataagcagttgc

SEQ ID NO: 161 - DNA, 20 bp, Artificial sequence
  Primer N886
caatgattgttggtaaaggg

SEQ ID NO: 162 - DNA, 30 bp, Artificial sequence
  Primer N1114
atatgctggtgatgagtaatctgttgtcat

SEQ ID NO: 163 - DNA, 30 bp, Artificial sequence
  Primer N1115
tttttgtgctaatgactcaaataaatccat

SEQ ID NO: 164 - DNA, 62 bp, Artificial sequence
  Primer N1176
gcatagcaatctaatctaagttccagctgaggatgacaacagattactcatcaccagcatat

SEQ ID NO: 165 - DNA, 62 bp, Artificial sequence
  Primer N1177
atcaacacacaaacactaaatcaaagctgaggatggatttatttgagtcattagcacaaaaa

SEQ ID NO: 166 - DNA, 63 bp, Artificial sequence
  Primer N1178
ggtatcgataagcttgatatcgaattcctgcgcccgggccactagtcagatgccgcgggcact

SEQ ID NO: 167 - DNA, 30 bp, Artificial sequence
  Primer N1214
aaaaagggggtagaagcgttttgaagctat

SEQ ID NO: 168 - DNA, 22 bp, Artificial sequence
  Primer oBP512
aaagttggcatagcggaaactt

SEQ ID NO: 169 - DNA, 7463 bp, Artificial sequence
  pRS423:GAL1p-Cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttatgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 170 - DNA, 1559 bp, Artificial sequence
  loxP-URA3-loxP
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 171 - DNA, 2237 bp, Artificial sequence
  PDC1 Fragment A-ilvDSm
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 172 - DNA, 4420 bp, Artificial sequence
  PDC1 A-ilvDSm-BUC cassette
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 173 - DNA, 3521 bp, Artificial sequence
  PDC5 A-sadB-BUC cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 174 - DNA, 1685 bp, Artificial sequence
  gpd2::loxP-URA3-loxP cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

SEQ ID NO: 175 - DNA, 11017 bp, Artificial sequence
  pRS426::GPD-xpk1+ADH-eutD
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 176 - DNA, 3015 bp, Artificial sequence
  modified locus: FBA1-alsS- CYCt in Chr. XII; Upstream region = nt 1-154; FBA1 promoter = nt 155-802; alsS CDS = nt 810-2525; CYC1 terminator = nt 2534-2788;
gcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaata

SEQ ID NO: 177 - DNA, 2900 bp, Artificial sequence
  modified locus: fra29delta)::PDC1-hADH-ADHt; Upstream region = nt 1-300; PDC1 promoter = nt 309-1178; hADH coding region = nt 1179-2306; ADH1 terminator = nt 2315-2630; Downstream region = nt 2639-2900
gttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatggcgcgccccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaa

SEQ ID NO: 178 - DNA, 2656 bp, Artificial sequence
  modified locus: yprcdelta15(delta)::PDC5-hADH-ADHt; Upstream region = nt 1-150; PDC5 promoter = nt 159-696; hADH coding region = nt 697-1824; ADH1 terminator = nt 1833-2148; Downstream region = nt 2157-2656;
ccaaaaggaatattgggtcagatgaatggacgcgaatgcaagacagaagtccaaatcacgtcaagacaaagaaagaaagaaagaaaaactaacacattaatgtagttttaaaatttcaaatccgaacaacagagcatagggtttcgcaaaggcgcgcctatttgtaatacgtatacgaattccttcaacaaaggccaaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgtcaacagccggtaaagttattaagtgtaaagcggcagttttgtgggaagagaaaaagccgtttagcatagaagaagtagaagtagcgccaccaaaagcacacgaggttagaatcaagatggttgccaccggaatctgtagatccgacgaccatgtggtgagtggcactctagttactcctttgccagtaatcgcgggacacgaggctgccggaatcgttgaatccataggtgaaggtgttaccactgttcgtcctggtgataaagtgatcccactgttcactcctcaatgtggtaagtgtagagtctgcaaacatcctgagggtaatttctgccttaaaaatgatttgtctatgcctagaggtactatgcaggatggtacaagcagatttacatgcagagggaaacctatacaccatttccttggtacttctacattttcccaatacacagtggtggacgagatatctgtcgctaaaatcgatgcagcttcaccactggaaaaagtttgcttgatagggtgcggattttccaccggttacggttccgcagttaaagttgcaaaggttacacagggttcgacttgtgcagtattcggtttaggaggagtaggactaagcgttattatggggtgtaaagctgcaggcgcagcgaggattataggtgtagacatcaataaggacaaatttgcaaaagctaaggaggtcggggctactgaatgtgttaaccctcaagattataagaaaccaatacaagaagtccttactgaaatgtcaaacggtggagttgatttctcttttgaagttataggccgtcttgatactatggtaactgcgttgtcctgctgtcaagaggcatatggagtcagtgtgatcgtaggtgttcctcctgattcacaaaatttgtcgatgaatcctatgctgttgctaagcggtcgtacatggaagggagctatatttggcggttttaagagcaaggatagtgttccaaaacttgttgccgactttatggcgaagaagtttgctcttgatcctttaattacacatgtattgccattcgagaaaatcaatgaagggtttgatttgttaagaagtggtgaatctattcgtacaattttaactttttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgtttaaacaatggaaggtcgggatgagcatatacaagcactaagaagaacaatacagaactctacacggtattattgtgctacaagctcgagtaaaaccgagtgttttgacgatactaacgttgttaagaaagtaacttgttatcaaactcattaccaacttgtgattaattggtgaataatatgataattgtcgaaattccattgttggtaaagcctataatattatgtatacagattatactagaaattctctcgagaatataagaatccccaaaattgaatcggtatttctacatactaatattaccattacttctcctttcgttttatatgtttcattcctattacattatcgatctttgcatttcagcttccattatatttgatgtctgttttatgtccccacgttacaccgcatgtgacagtatactagtaacatgagtgctaccgaatagatgacattttagactttcattccaacaacttggttgacagaatgttacgta

SEQ ID NO: 179 - DNA, 451 bp, Artificial sequence
  modified locus: ymr226c(delta); Upstream region = nt 1-250; Downstream region = nt 251-451
gatgatgctatttggtgcagagggtgatgagtaagttctctttatcatctatatattactcttatacactatacgactctactctatgacgtatagcattgatatatattaaggcacgacaccgatttttcttatcggagcgatataaaaagctgaagaaaggaggatagatgaaacagcatggcgcatagaaagtgttcaagctcactagtaaaggcgggaaatagaacattgagaacgtattttgataacctagctaaactaagtaaatctgtatactttttatacatgtaagactttttagctatttcattcttccctgaaccgttttgcgcgattctacggaatataccggcgaaataaaagagataaacttatggatcctcaaatagaggatgaacagatgtgaagaagaaacgagcttaattatatcttcgccatgataactaaa

SEQ ID NO: 180 - DNA, 1128 bp, Artificial sequence
  modified locus: ald6(delta)::loxP; Upstream region = nt 1-500; loxP site = nt 551-584; Downstream region = nt 678-1128;
tgatctgatgcgctttgcatatctcatattccttcactagcataaaaatccaaaaaaaaagaatatttaggccgaatggaattattcgtaacgtcatacgaaaaaagtttcaattcgtacaatgcctggcatgttcattcgaatataaggccgccgccttccagtcagggtagccaaaagtataatcccgggtggaaactaaactaaaaaccgtactcacaactttccgcggacgctaacagacaaatagacacactatcaggtcaggaactgccgtcacatacgacactgcccctcacgtaagggcatgatagaattggattatgtaaaaggtgaagataccattgtagaagcaaccagcacgtcgccgtggctgatgaggtctcctcttgcccgggccgcagaaaagaggggcagtggcctgtttttcgacataaatgaggggcatggccagcaccgagacgtcattgttgcatatggcgtatccaagccgaaacggcggtaccgcaagggcgaattcaccttggctaactcgttgtatcatcactggataacttcgtataatgtatgctatacgaagttatctgaacattagaatacgtaatccgcaatgcggatcctctagagtcgacctgcaggcatgctcgagcggccgccagtgtgatggatatctgcagaattcgcccttgccgatcgtgtaccaacctgcatttctttccgtcatatacacaaaatactttcatataaacttacttggtcttacgtcataaataaatatgtatacatataaattaaaaaatttggttttatatttttacaaaaagaatcgtttacttcatttctcccttttaagcgatacaatccatgaaaaaagagaaaaagagagaacaggcttgtgccttctttaaaacatcccacacaaaatcatattgaattgaattttacatcttaagctagtgtacaacaactgctatatccaaagaaaactaacgtggaccgcttttagagttgagaaaaaggtttgaaaaaaatagcaatacaaagacttgtttcatatataaaatacagggagcacattgagctaatataacataaacactgcgaaccaattccaatcaaaaggtacac

SEQ ID NO: 181 - DNA, 9612 bp, Artificial sequence
  pLH702
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgatattttcctctggccctgcaggcctatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 182 - DNA, 7938 bp, Artificial sequence
  pYZ067DkivDDhADH
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatcccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 183 - DNA, 7317 bp, Artificial sequence
  pTVAN6
aaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctg

SEQ ID NO: 184 - skipped

SEQ ID NO: 185 - DNA, 5060 bp, Artificial sequence
  pBP1236
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatttaaatggcgcgccgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgcggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcatgacaggtgaaagaattgaaaaggtgaaaataaatgacgaatttgcaaaatcacatttcctaacaactcagtggagagaaacaaagcgccaacgacactataagatgcccgtttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 186 - DNA, 6611 bp, Artificial sequence
  pNAK15
cgcgccgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgcggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcatgacaggtgaaagaattgaaaaggtgaaaataaatgacgaatttgcaaaatcacatttcctaacaactcagtggagagaaacaaagcgccaacgacactataagatgcccgtttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatttaaatggcgcgccatagcttcagaatgtttctactccttttttactcttccagattttctcggactccgcgcatcgccgtaccacttcaaaacacccaagcacagcatactaaatttcccctctttcttcctctagggtgtcgttaactacccgtactaaaggtttggaaaaaaaaaagagaccgcctcgtttctttttcttcgccgaaaaaggcaataaaaatttttatcacgtttctttttcttgaaaattttttttttgatttttttctctttcgatgacctcccattgatatttaagttaataaacggtcttcaatttctcaagtttcagtttcatttttcttgctctattacaactttttttacttcttgctcattagaaagaaagcatagcaatctaatctaagtttcagctgaggatgagatcatcactagtgttgtttttcgtaagtgcttggactgcattggcttctccaattagaagagaagtttcccaagacctgtttaaccaattcaatctttttgctcaatactctgcagccgcatactgtggtaaaaacaatgatgccccagcagggacaaacattacatgtactggaaacgcctgccctgaagtagaaaaggctgacgccacctttttgtactctttcgaagattcaggtgttggcgatgtgacaggttttctagctttggacaacaccaacaaattgatcgttctgtctttcaggggttctagatctatcgaaaattggattggcaacctcaattttgatctgaaagagatcaatgatatatgctcagggtgtagaggacatgatggcttcactagttcctggagatcagtcgcagatacgttgcgtcaaaaggtcgaggatgctgttcgggaacatccagattacagagtagtgttcacagggcactccttaggtggtgccttagctactgttgccggtgctgaccttagaggcaatggttacgacattgatgtttttagctatggcgcacctagggttggaaatcgtgcgtttgctgaatttctcacagtgcagacaggaggcacattatacagaattactcatactaatgatatagtcccaaggttaccaccacgggagttcggttacagtcactcttctccagaatattggatcaaatcagggactctagtccctgttacccgtaacgacatcgtaaagattgaaggtatcgatgcaacaggtggaaataatcaacctaatatacctgacatcccagcgcatttgtggtattttggtttaataggaacatgtctttaattaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggg

SEQ ID NO: 187 - DNA, 6611 bp, Artificial sequence
  pNAK16
cgcgccgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgcggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcatgacaggtgaaagaattgaaaaggtgaaaataaatgacgaatttgcaaaatcacatttcctaacaactcagtggagagaaacaaagcgccaacgacactataagatgcccgtttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatttaaatggcgcgccccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatgg

SEQ ID NO: 188 - DNA, 6611 bp, Artificial sequence
  pNAK17
cgcgccatagcttcagaatgtttctactccttttttactcttccagattttctcggactccgcgcatcgccgtaccacttcaaaacacccaagcacagcatactaaatttcccctctttcttcctctagggtgtcgttaactacccgtactaaaggtttggaaaaaaaaaagagaccgcctcgtttctttttcttcgccgaaaaaggcaataaaaatttttatcacgtttctttttcttgaaaattttttttttgatttttttctctttcgatgacctcccattgatatttaagttaataaacggtcttcaatttctcaagtttcagtttcatttttcttgctctattacaactttttttacttcttgctcattagaaagaaagcatagcaatctaatctaagtttcagctgaggatgagatcatcactagtgttgtttttcgtaagtgcttggactgcattggcttctccaattagaagagaagtttcccaagacctgtttaaccaattcaatctttttgctcaatactctgcagccgcatactgtggtaaaaacaatgatgccccagcagggacagctattacatgtactggaaacgcctgccctgaagtagaaaaggctgacgccacctttttgtactctttcgaagattcaggtgttggcgatgtgacaggttttctagctttggacaacaccaacaaattgatcgttctgtctttcaggggttctagatctatcgaaaattggattggcaacctcaattttgatctgaaagagatcaatgatatatgctcagggtgtagaggacatgatggcttcactagttcctggagatcagtcgcagatacgttgcgtcaaaaggtcgaggatgctgttcgggaacatccagattacagagtagtgttcacagggcactccttaggtggtgccttagctactgttgccggtgctgaccttagaggcaatggttacgacattgatgtttttagctatggcgcacctagggttggaaatcgtgcgtttgctgaatttctcacagtgcagacaggaggcacattatacagaattactcatactaatgatatagtcccaaggttaccaccacgggagttcggttacagtcactcttctccagaatattggatcaaatcagggactctagtccctgttacccgtaacgacatcgtaaagattgaaggtatcgatgcaacaggtggaaataatcaacctaatatacctgacatcccagcgcatttgtggtattttggtttaataggaacatgtctttaattaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggggcgcgccgtttaaacaaaggatgatattgttctattattaagtttcgaaaggagacggcattgaatctttttggcatagacgattttgctttcttacgttatttacatcggagagtatgtatttgtgtagttatgtacttagatatgtaacttaatttaatgatatggtggggggctatcctccatgccccatttccagttatttgaaggttcttgcgagttcaaacctatgaagtaaaacggtttctttttagatgtatctttcttggagtccaaatttagcgatattttttctggtataacgtatttatcccttatcgatactgttgttttcaaatatgggggagattgttcttcaagctcgggtatcggtgtttggaccggtgtggacgtaactgtttcaatagcagtactatcatcaacagcctgttctccttgtgattgtaggttcgatggtgtgcgggtctttttgcatttgatctttcttctccttggtttggcattgtcgtcgttgcggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcatgacaggtgaaagaattgaaaaggtgaaaataaatgacgaatttgcaaaatcacatttcctaacaactcagtggagagaaacaaagcgccaacgacactataagatgcccgtttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccgcgatcgcgacgttctctccgttgttcaaacccctaaccaaccagtcatttacaccgccacgagcggcatctacggcagtgtgagggcagtatacggatattccgtactggattagctttatagctgtctcgtgttgtgggtttgtatgtgggcttaatctgttccagcttgggaaaataaaaggatggtaagcaacaattacgttgcagttagcatccacagcttcttgagcaactgacttcgtgaggtctacagtcaaaaggacctttgttttagcgtttgcatcggcagtggtgacttgtgcagtggaacaatcgatgagaagacccgtattgtcccagctcttgtctgcgtacttttgagggtagaacttggtaatgctacgcacaagtttgtccaattgtgctctagtaatagctctgctcattgcgtttcggtggactcttgttctgtttccttccgactgtgtattggaataagtttttcggtgttatatatatacatatatatttaaatgg

SEQ ID NO: 189 - DNA, 34 bp, Artificial sequence
  Primer oBP625
aattggccggcctacgtaacattctgtcaaccaa

SEQ ID NO: 190 - DNA, 34 bp, Artificial sequence
  oBP626
aattgcggccgcttcatatatgacgtaataaaat

SEQ ID NO: 191 - DNA, 34 bp, Artificial sequence
  oBP627
aattttaattaattttttttcttggaatcagtac

SEQ ID NO: 192 - DNA, 40 bp, Artificial sequence
  Primer HY21
ttaaggcgcgcctatttgtaatacgtatacgaattccttc

SEQ ID NO: 193 - DNA, 56 bp, Artificial sequence
  Primer HY24
acttaataactttaccggctgttgacattttgttcttcttgttattgtattgtgtt

SEQ ID NO: 194 - DNA, 56 bp, Artificial sequence
  Primer HY25
aacacaatacaataacaagaagaacaaaatgtcaacagccggtaaagttattaagt

SEQ ID NO: 195 - DNA, 40 bp, Artificial sequence
  Primer HY4
ggaagtttaaacaccacaggtgttgtcctctgaggacata

SEQ ID NO: 196 - DNA, 30 bp, Artificial sequence
  Primer URA3-end F
gcatatttgagaagatgcggccagcaaaac

SEQ ID NO: 197 - DNA, 22 bp, Artificial sequence
  Primer oBP637
tttttgcacagttaaactaccc

SEQ ID NO: 198 - DNA, 22 bp, Artificial sequence
  Primer oBP636
catttttttccctctaagaagc

SEQ ID NO: 199 - DNA, 34 bp, Artificial sequence
  Primer oBP695
aattgcggccgcatgacaggtgaaagaattgaaa

SEQ ID NO: 200 - DNA, 34 bp, Artificial sequence
  Primer HY31
gccgactttatggcgaagaagtttgctcttgatc

SEQ ID NO: 201 - DNA, 34 bp, Artificial sequence
  Primer oBP693
aattgtttaaacaaaggatgatattgttctatta

SEQ ID NO: 202 - DNA, 33 bp, Artificial sequence
  Primer oBP694
aattggccggccgcaacgacgacaatgccaaac

SEQ ID NO: 203 - DNA, 56 bp, Artificial sequence
  Primer HY20
gcaaaataacacagtcaaatcaatcaaaatgtcaacagccggtaaagttattaagt

SEQ ID NO: 204 - DNA, 41 bp, Artificial sequence
  Primer oBP692
aattggcgcgccatttaaatatatatgtatatatataacac

SEQ ID NO: 205 - DNA, 40 bp, Artificial sequence
  Primer HY16
ttaaggcgcgccccgcacgccgaaatgcatgcaagtaacc

SEQ ID NO: 206 - DNA, 56 bp, Artificial sequence
  Primer HY19
acttaataactttaccggctgttgacattttgattgatttgactgtgttattttgc

SEQ ID NO: 207 - DNA, 36 bp, Artificial sequence
  Primer oBP821
aattgtttaaactaagcgaatttcttatgatttatg

SEQ ID NO: 208 - DNA, 34 bp, Artificial sequence; identical to SEQ ID NO: 116
  Primer oBP484

SEQ ID NO: 209 - DNA, 37 bp, Artificial sequence
  oBP822
aattgcggccgcgtgcctcatctatatttctgaaatc

SEQ ID NO: 210 - DNA, 37 bp, Artificial sequence
  Primer oBP823
aattttaattaatcagctcttgttttgttctgcaaat

SEQ ID NO: 211 - DNA, 1647 bp, Artificial sequence
  kivD coding region from Listeria grayi codon optimized for expression in Saccharomyces cerevisiae
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 212 - DNA, 36 bp, Artificial sequence
  Primer oBP828
aattgtttaaacatgtataccgtaggacagtacttg

SEQ ID NO: 213 - DNA, 35 bp, Artificial sequence
  Primer oBP829
aattgtttaaacttaagagttttgcttagataagg

SEQ ID NO: 214 - DNA, 60 bp, Artificial sequence
  Primer oBP830
tatttaataataaaaatcataaatcataagaaattcgcttaagagttttgcttagataag

SEQ ID NO: 215 - DNA, 22 bp, Artificial sequence
  Primer AK11-46
ggttcttcaggaggttctggtg

SEQ ID NO: 216 - DNA, 74 bp, Artificial sequence
  Primer AK11-47
tcatgtaattagttatgtcacgcttacattcacgccctccccccacatccttagaatagcaggtacgacaaaag

SEQ ID NO: 217 - DNA, 4524 bp, Artificial sequence
  pGS-SAG1 plasmid
aagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttggttcttcaggaggttctggtggctccggtggatcaggttctagcgccaaaagctcttttatctcaaccactactactgatttaacaagtataaacactagtgcgtattccactggatccatttccacagtagaaacaggcaatcgaactacatcagaagtgatcagccatgtggtgactaccagcacaaaactgtctccaactgctactaccagcctgacaattgcacaaaccagtatctattctactgactcaaatatcacagtaggaacagatattcacaccacatcagaagtgattagtgatgtggaaaccattagcagagaaacagcttcgaccgttgtagccgctccaacctcaacaactggatggacaggcgctatgaatacttacatctcgcaatttacatcctcttctttcgcaacaatcaacagcacaccaataatctcttcatcagcagtatttgaaacctcagatgcttcaattgtcaatgtgcacactgaaaatatcacgaatactgctgctgttccatctgaagagcccacttttgtaaatgccacgagaaactccttaaattccttctgcagcagcaaacagccatccagtccctcatcttatacgtcttccccactcgtatcgtccctctccgtaagcaaaacattactaagcaccagttttacgccttctgtgccaacatctaatacatatatcaaaacgaaaaatacgggttactttgagcacacggctttgacaacatcttcagttggccttaattcttttagtgaaacagcagtctcatctcagggaacgaaaattgacacctttttagtgtcatccttgatcgcatatccttcttctgcatcaggaagccaattgtccggtatccaacagaatttcacatcaacttctctcatgatttcaacctatgaaggtaaagcgtctatatttttctcagctgagctcggttcgatcatttttctgcttttgtcgtacctgctattctaa

SEQ ID NO: 218 - DNA, 70 bp, Artificial sequence
  Primer Sagtgap1
ctgacatcccagcgcatttgtggtattttggtttaataggaacatgtcttggttcttcaggaggttctgg

SEQ ID NO: 219 - DNA, 74 bp, Artificial sequence
  Primer Sagtgap2
ggatgtggggggagggcgtgaatgtaagcgtgacataactaattacatgattagaatagcaggtacgacaaaag

SEQ ID NO: 220 - DNA, 7336 bp, Artificial sequence
  pTVAN11
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaatggtgatggtgatgatgaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctgaaacttggattagattgctatgctcccgttctactgagtgagaagtaagaagggtcgtaataggacgggagaaaggaaactgaaacttgagaggttgaagaccgttcattaacctaaataccaacgggaggccgtcgaaagagaacaagatcgaagaaaaggttctcaaggaaaggagacatgataaaaacttctattgcccccttcgacgaagaaaagaagacgaggcggtctctttctccttccccaaacccttagtacgagtaactagtgacaccctagaggaagaaagaggggagatttggtatgctgcgcttgggggctttgaggtggtacggcgatgcgcggagtctgagaaaacctggaggagtaaagggggagccgaagcactttagagccgtccgc

SEQ ID NO: 221 - DNA, 7336 bp, Artificial sequence
  pTVAN12
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaatggtgatggtgatgatgaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 222 - DNA, 7335 bp, Artificial sequence
  pTVAN13
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaatggtgatggtgatgatgaagacatgttcctattaaaccaaaataccacaaatgcgctgggatgtcaggtatattaggttgattatttccacctgttgcatcgataccttcaatctttacgatgtcgttacgggtaacagggactagagtccctgatttgatccaatattctggagaagagtgactgtaaccgaactcccgtggtggtaaccttgggactatatcattagtatgagtaattctgtataatgtgcctcctgtctgcactgtgagaaattcagcaaacgcacgatttccaaccctaggtgcgccatagctaaaaacatcaatgtcgtaaccattgcctctaaggtcagcaccggcaacagtagctaaggcaccacctaaggagtgccctgtgaacactactctgtaatctggatgttcccgaacagcatcctcgaccttttgacgcaacgtatctgcgactgatctccaggaactagtgaagccatcatgtcctctacaccctgagcatatatcattgatctctttcagatcaaaattgaggttgccaatccaattttcgatagatctagaacccctgaaagacagaacgatcaatttgttggtgttgtccaaagctagaaaacctgtcacatcgccaacacctgaatcttcgaaagagtacaaaaaggtggcgtcagccttttctacttcagggcaggcgtttccagtacatgtaatgtttgtccctgctggggcatcattgtttttaccacagtatgcggctgcagagtattgagcaaaaagattgaattggttaaacaggtcttgggaaacttctcttctaattggagaagccaatgcagtccaagcacttacgaaaaacaacactagtgatgatctcatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 223 - DNA, 5030 bp, Artificial sequence
  pNAK36
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaggtacccggggatccggcgcgccgtttaaaccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcgcattgcggattacgtattctaatgttcagataacttcgtatagcatacattatacgaagttatccagtgatgatacaacgagttagccaaggtgacactttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 224 - DNA, 6734 bp, Artificial sequence
  pNAK38
cgcgccgtttaaaccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcgcattgcggattacgtattctaatgttcagataacttcgtatagcatacattatacgaagttatccagtgatgatacaacgagttagccaaggtgacactttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaggtacccggggatccggcgcgccatagcttcagaatgtttctactccttttttactcttccagattttctcggactccgcgcatcgccgtaccacttcaaaacacccaagcacagcatactaaatttcccctctttcttcctctagggtgtcgttaactacccgtactaaaggtttggaaaaaaaaaagagaccgcctcgtttctttttcttcgccgaaaaaggcaataaaaatttttatcacgtttctttttcttgaaaattttttttttgatttttttctctttcgatgacctcccattgatatttaagttaataaacggtcttcaatttctcaagtttcagtttcatttttcttgctctattacaactttttttacttcttgctcattagaaagaaagcatagcaatctaatctaagtttcagctgaggatgaagctactttccttgacaggtgtagctggcgtactggctacttgtgtcgccgcaacaccactagtcaaaagactaccatccggtagtgaccctgccttttctcaaccaaagtcagtcttggatgcaggtttaacatgccaaggtgcctcaccatctagtgtctcaaagcctatcttattggtacctggtactggtacaaccggaccacaatcattcgactctaattggatcccattatccactcaattaggctatactccatgttggatttcacctccaccattcatgcttaatgatactcaagtgaatactgagtacatggttaatgcaattactgccctatacgctggatccggaaacaataagttgccagtcttaacttggtcccaaggcggcttggttgcacaatggggactaacctttttccctagtataagatctaaagtggatagactgatggctttcgcaccagattacaagggaaccgttctagcaggccctcttgatgccctggcagtttcagcccctagtgtttggcaacaaacaactggttctgcattgacaaccgctttgagaaatgccggtgggttaacacaaatcgtgcctacaactaacttgtattctgccacagatgaaatcgttcaacctcaggtatctaattcaccactagactcttcatacctgtttaacggcaaaaacgtacaggcccaagctgtttgcggtccattgtttgtcatcgatcatgctgggtccttgacttctcaattctcttatgtggtgggtagatctgccttaagatctactacagggcaggctagatcagcagactacggcataaccgactgtaatccacttccagccaacgatttgacacctgaacagaaagtagccgctgcagctcttttagcaccagctgctgctgcaattgttgcaggtccaaaacaaaactgcgaaccagaccttatgccatacgctaggccttttgctgtgggtaaacgtacatgtagtggtatagttacaccataattaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggg

SEQ ID NO: 225 - DNA, 6712 bp, Artificial sequence
  pNAK37
cgcgccgtttaaaccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcgcattgcggattacgtattctaatgttcagataacttcgtatagcatacattatacgaagttatccagtgatgatacaacgagttagccaaggtgacactttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaggtacccggggatccggcgcgccccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaacttagataccgcaaaccccttgtgttacaaagtattgcaagtgatttcctaagacattagcctgctgtagcagtgtatttcctgcactgcattgcttgtttctctgtccttcgcatgtaacaacattagacagtggaggatgtatcagtggccaatcgataaagacttcaccagaacaatgttgataaccatcccaaaaaggtatttgaggcacaatgtcccctctatgtgtgatcctgtatagttttctatcttttgttaccttggatacatcaggattctcttccccgaaaaacaacctatcgacccaattagcgaatccagcatttcccactataggttggcctagggtgacaactagtggatcatgaccgtttactttcaagttgattccgaacaatagggctgcagcaccacccagtgaatgaccggtaactgcaatttcgtaatctgggtgctctgctatcacagaatctaactttggaccaatctggttgaatgtattgttgtaagattcgataaagcctttatggactaaacagtcatcacaagtggctgttgaactgatattggctgcaaaatcaaagttggtcaatggagcctgaaggatacgaatgtcagtgattacatcttctaatgagtgggtacctcttatgacaaggtagatttgtttggatgtatgatcaactgcaagataaccggaaacgtcaaatacaagtcttgggtcgtggaactcttgaatcaattccacatttggaaaatgggcacattgtaagccacaattgaaaggtttgaaaatcttagtgcctgggccaacacaataaccgatgttggccaatcttgcgtatttctcgaaaaagttgtaagagtcttggttaatgtgtgaagtttcagtagatgtatacactctcttttgtaaagcagcagcttctgatggtgtaacaggtgaaggcaaagcggccaccaaagtagcgcaggcagtcaacagaattgtagatagcttcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatgg

SEQ ID NO: 226 - DNA, 6710 bp, Artificial sequence
  pNAK39
cgcgccgtttaaaccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcgcattgcggattacgtattctaatgttcagataacttcgtatagcatacattatacgaagttatccagtgatgatacaacgagttagccaaggtgacactttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctccttagcctctagccatagccatcatgcaagcgtgtatcttctaagattcagtcatcatcattaccgagtttgttttccttcacatgatgaagaaggtttgagtatgctcgaaacaataagacgacgatggctctgccattgttatattacgcttttgcggcgaggtgccgatgggttgctgaggggaagagtgtttagcttacggacctattgccattgttattccgattaatctattgttcagcagctcttctctaccctgtcattctagtattttttttttttttttttggttttacttttttttcttcttgcctttttttcttgttactttttttctagttttttttccttccactaagctttttccttgatttatccttgggttcttctttctactcctttagattttttttttatatattaatttttaagtttatgtattttggtagattcaattctctttccctttccttttccttcgctccccttccttatcaggtacccggggatccggcgcgccatagcttcagaatgtttctactccttttttactcttccagattttctcggactccgcgcatcgccgtaccacttcaaaacacccaagcacagcatactaaatttcccctctttcttcctctagggtgtcgttaactacccgtactaaaggtttggaaaaaaaaaagagaccgcctcgtttctttttcttcgccgaaaaaggcaataaaaatttttatcacgtttctttttcttgaaaattttttttttgatttttttctctttcgatgacctcccattgatatttaagttaataaacggtcttcaatttctcaagtttcagtttcatttttcttgctctattacaactttttttacttcttgctcattagaaagaaagcatagcaatctaatctaagtttcagctgaggatgaagctatctacaattctgttgactgcctgcgctactttggtggccgctttgccttcacctgttacaccatcagaagctgctgctttacaaaagagagtgtatacatctactgaaacttcacacattaaccaagactcttacaactttttcgagaaatacgcaagattggccaacatcggttattgtgttggcccaggcactaagattttcaaacctttcaattgtggcttacaatgtgcccattttccaaatgtggaattgattcaagagttccacgacccaagacttgtatttgacgtttccggttatcttgcagttgatcatacatccaaacaaatctaccttgtcataagaggtacccactcattagaagatgtaatcactgacattcgtatccttcaggctccattgaccaactttgattttgcagccaatatcagttcaacagccacttgtgatgactgtttagtccataaaggctttatcgaatcttacaacaatacattcaaccagattggtccaaagttagattctgtgatagcagagcacccagattacgaaattgcagttaccggtcattcactgggtggtgctgcagccctattgttcggaatcaacttgaaagtaaacggtcatgatccactagttgtcaccctaggccaacctatagtgggaaatgctggattcgctaattgggtcgataggttgtttttcggggaagagaatcctgatgtatccaaggtaacaaaagatagaaaactatacaggatcacacatagaggggacattgtgcctcaaatacctttttgggatggttatcaacattgttctggtgaagtctttatcgattggccactgatacatcctccactgtctaatgttgttacatgcgaaggacagagaaacaagcaatgcagtgcaggaaatacactgctacagcaggctaatgtcttaggaaatcacttgcaatactttgtaacacaaggggtttgcggtatctaattaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggg

SEQ ID NO: 227 - DNA, 28 bp, Artificial sequence
  Primer HY48
gtaaccgtgcgcgatgagctaatcctga

SEQ ID NO: 228 - DNA, 28 bp, Artificial sequence
  HY49
gcaagaacaagggagtacgaatgtatgc

SEQ ID NO: 229 - DNA, 72 bp, Artificial sequence
  Primer Atublip1
ttgctcgttagagagaaagcatagcaatctaatctaagttccagctgaggatgttttcaggtagattcggcg

SEQ ID NO: 230 - DNA, 74 bp, Artificial sequence
  Primer AtubLip2
ggggagggcgtgaatgtaagcgtgacataactaattacatgattaattaattaaagcaaacattcagagatcgc

SEQ ID NO: 231 - DNA, 8158 bp, Artificial sequence
  pNAK33
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctgaaacttggattagattgctatgctcccgttctactgagtgagaagtaagaagggtcgtaataggacgggagaaaggaaactgaaacttgagaggttgaagaccgttcattaacctaaataccaacgggaggccgtcgaaagagaacaagatcgaagaaaaggttctcaaggaaaggagacatgataaaaacttctattgcccccttcgacgaagaaaagaagacgaggcggtctctttctccttccccaaacccttagtacgagtaactagtgacaccctagaggaagaaagaggggagatttggtatgctgcgcttgggggctttgaggtggtacggcgatgcgcggagtctgagaaaacctggaggagtaaagggggagccgaagcactttagagccgtccgc

SEQ ID NO: 232 - DNA, 8158 bp, Artificial sequence
  pNAK34
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 233 - DNA, 8157 bp, Artificial sequence
  pNAK35
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 234 - DNA, 7336 bp, Artificial sequence
  pTVAN9
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagcaaacattcagagatcgcgaaaaagtaccagagatgagcaacaacggatactgttgcttcgccagcattcccagctgtagaattgatgccttcgattacttcaatatcgcttgcagtaactgaagctccgtttccagatgttatccaatattctggagatggctgactaaaaccaaaatccattggtgggactctaggaacaatgtcattcaagtgagtgactctaaagtttgcaccactgccttgagaagtaatatgttcagctagtgcatagtttcctatccttgggcatccgtaggtgtataattctacactatacccgtcatttctcaagacagtcgcacccagtgtggccaaagcacctcccaaggaatgacccgtgaagtacaatgtgtaaccagagtaagtagacattgctgacttgatcttagatgtcaattcgtcagcagctgattcccaggctttccaaaaacctgtgtgcactttgcagccagtacacaagtcatcattatcttcaaggatgaaatcaaggttagctatccagttctcaatagttgatgatcctctaaacgcgaccactaatctcttattggtattatcggctgctaaaaacccggcagtaccaccgaaatcattggtcagatcgaactctaatagcattgtcgtggaagcctcctcaacagaaggacaagcattggctgtgcatgttaagttactgtcttttgaatcaatattgtttgaacagtaggctgcagcagaccattgggcaaagagttgtagttcatcaagggtggaagtgctaacagaacgcactgctaatggggcaggcgctgcagcacccaatgcagctaatgctgtcagtagaacgccgaatctacctgaaaacatcctcagctgaaacttggattagattgctatgctcccgttctactgagtgagaagtaagaagggtcgtaataggacgggagaaaggaaactgaaacttgagaggttgaagaccgttcattaacctaaataccaacgggaggccgtcgaaagagaacaagatcgaagaaaaggttctcaaggaaaggagacatgataaaaacttctattgcccccttcgacgaagaaaagaagacgaggcggtctctttctccttccccaaacccttagtacgagtaactagtgacaccctagaggaagaaagaggggagatttggtatgctgcgcttgggggctttgaggtggtacggcgatgcgcggagtctgagaaaacctggaggagtaaagggggagccgaagcactttagagccgtccgc

SEQ ID NO: 235 - DNA, 7336 bp, Artificial sequence
  pTVAN4
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagcaaacattcagagatcgcgaaaaagtaccagagatgagcaacaacggatactgttgcttcgccagcattcccagctgtagaattgatgccttcgattacttcaatatcgcttgcagtaactgaagctccgtttccagatgttatccaatattctggagatggctgactaaaaccaaaatccattggtgggactctaggaacaatgtcattcaagtgagtgactctaaagtttgcaccactgccttgagaagtaatatgttcagctagtgcatagtttcctatccttgggcatccgtaggtgtataattctacactatacccgtcatttctcaagacagtcgcacccagtgtggccaaagcacctcccaaggaatgacccgtgaagtacaatgtgtaaccagagtaagtagacattgctgacttgatcttagatgtcaattcgtcagcagctgattcccaggctttccaaaaacctgtgtgcactttgcagccagtacacaagtcatcattatcttcaaggatgaaatcaaggttagctatccagttctcaatagttgatgatcctctaaacgcgaccactaatctcttattggtattatcggctgctaaaaacccggcagtaccaccgaaatcattggtcagatcgaactctaatagcattgtcgtggaagcctcctcaacagaaggacaagcattggctgtgcatgttaagttactgtcttttgaatcaatattgtttgaacagtaggctgcagcagaccattgggcaaagagttgtagttcatcaagggtggaagtgctaacagaacgcactgctaatggggcaggcgctgcagcacccaatgcagctaatgctgtcagtagaacgccgaatctacctgaaaacatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 236 - DNA, 7335 bp, Artificial sequence
  pTVAN10
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattaaagcaaacattcagagatcgcgaaaaagtaccagagatgagcaacaacggatactgttgcttcgccagcattcccagctgtagaattgatgccttcgattacttcaatatcgcttgcagtaactgaagctccgtttccagatgttatccaatattctggagatggctgactaaaaccaaaatccattggtgggactctaggaacaatgtcattcaagtgagtgactctaaagtttgcaccactgccttgagaagtaatatgttcagctagtgcatagtttcctatccttgggcatccgtaggtgtataattctacactatacccgtcatttctcaagacagtcgcacccagtgtggccaaagcacctcccaaggaatgacccgtgaagtacaatgtgtaaccagagtaagtagacattgctgacttgatcttagatgtcaattcgtcagcagctgattcccaggctttccaaaaacctgtgtgcactttgcagccagtacacaagtcatcattatcttcaaggatgaaatcaaggttagctatccagttctcaatagttgatgatcctctaaacgcgaccactaatctcttattggtattatcggctgctaaaaacccggcagtaccaccgaaatcattggtcagatcgaactctaatagcattgtcgtggaagcctcctcaacagaaggacaagcattggctgtgcatgttaagttactgtcttttgaatcaatattgtttgaacagtaggctgcagcagaccattgggcaaagagttgtagttcatcaagggtggaagtgctaacagaacgcactgctaatggggcaggcgctgcagcacccaatgcagctaatgctgtcagtagaacgccgaatctacctgaaaacatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 237 - DNA, 12319 bp, Artificial sequence
  pBP2092
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgctaaggattggaaaagagctgaagaacaaggtttcgaagtctacaccgctgctgaagctgctaagaaggctgacatcattatgatcttgatcaacgatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaataatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttcttcctgatgagcaagaagtaaaaaaagttgtaatagaacaagaaaaatgaaactgaaacttgaggaattaaaggccgtttattaacctaaatatcaatgggaggtcatcggaagagaaaaaaattaaaaaaaaaattttcaagaaaaaggagcgtggtaagaatttttattgccttttccgacgaagagagagaaacgaggcggtctctttttcctcttccaaacctttagtacgggtaattaacgacaccctagaggaagaaagaggggaaatttagtatgctgtgcttgggtgttttgaagtggtacggcgatacgcggagtccgggaaaatctggaagagtaaagaaggagtagaaacattttgaggctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 238 - DNA, 7446 bp, Artificial sequence
  pNAK31
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattagataccgcaaaccccttgtgttacaaagtattgcaagtgatttcctaagacattagcctgctgtagcagtgtatttcctgcactgcattgcttgtttctctgtccttcgcatgtaacaacattagacagtggaggatgtatcagtggccaatcgataaagacttcaccagaacaatgttgataaccatcccaaaaaggtatttgaggcacaatgtcccctctatgtgtgatcctgtatagttttctatcttttgttaccttggatacatcaggattctcttccccgaaaaacaacctatcgacccaattagcgaatccagcatttcccactataggttggcctagggtgacaactagtggatcatgaccgtttactttcaagttgattccgaacaatagggctgcagcaccacccagtgaatgaccggtaactgcaatttcgtaatctgggtgctctgctatcacagaatctaactttggaccaatctggttgaatgtattgttgtaagattcgataaagcctttatggactaaacagtcatcacaagtggctgttgaactgatattggctgcaaaatcaaagttggtcaatggagcctgaaggatacgaatgtcagtgattacatcttctaatgagtgggtacctcttatgacaaggtagatttgtttggatgtatgatcaactgcaagataaccggaaacgtcaaatacaagtcttgggtcgtggaactcttgaatcaattccacatttggaaaatgggcacattgtaagccacaattgaaaggtttgaaaatcttagtgcctgggccaacacaataaccgatgttggccaatcttgcgtatttctcgaaaaagttgtaagagtcttggttaatgtgtgaagtttcagtagatgtatacactctcttttgtaaagcagcagcttctgatggtgtaacaggtgaaggcaaagcggccaccaaagtagcgcaggcagtcaacagaattgtagatagcttcatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 239 - skipped

SEQ ID NO: 240 - DNA, 7470 bp, Artificial sequence
  pTVAN8
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattatggtgtaactataccactacatgtacgtttacccacagcaaaaggcctagcgtatggcataaggtctggttcgcagttttgttttggacctgcaacaattgcagcagcagctggtgctaaaagagctgcagcggctactttctgttcaggtgtcaaatcgttggctggaagtggattacagtcggttatgccgtagtctgctgatctagcctgccctgtagtagatcttaaggcagatctacccaccacataagagaattgagaagtcaaggacccagcatgatcgatgacaaacaatggaccgcaaacagcttgggcctgtacgtttttgccgttaaacaggtatgaagagtctagtggtgaattagatacctgaggttgaacgatttcatctgtggcagaatacaagttagttgtaggcacgatttgtgttaacccaccggcatttctcaaagcggttgtcaatgcagaaccagttgtttgttgccaaacactaggggctgaaactgccagggcatcaagagggcctgctagaacggttcccttgtaatctggtgcgaaagccatcagtctatccactttagatcttatactagggaaaaaggttagtccccattgtgcaaccaagccgccttgggaccaagttaagactggcaacttattgtttccggatccagcgtatagggcagtaattgcattaaccatgtactcagtattcacttgagtatcattaagcatgaatggtggaggtgaaatccaacatggagtatagcctaattgagtggataatgggatccaattagagtcgaatgattgtggtccggttgtaccagtaccaggtaccaataagataggctttgagacactagatggtgaggcaccttggcatgttaaacctgcatccaagactgactttggttgagaaaaggcagggtcactaccggatggtagtcttttgactagtggtgttgcggcgacacaagtagccagtacgccagctacacctgtcaaggaaagtagcttcatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 241 - protein, 352 aa, Aspergillus kawachii
MFSGRFGVLLTALAALGAAAPAPLAVRSVSTSTLDELQLFAQWSAAAYCSNNIDSKDSNLTCTANACPSVEEASTTMLLEFDLTNDFGGTAGFLAADNTNKRLVVAFRGSSTIENWIANLDFILEDNDDLCTGCKVHTGFWKAWESAADELTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGNGASVTASDIEVIEGINSTAGNAGEATLSHPRVATTIASGASVVLLYYSIRRPTFHPHPAPPQNLPESVNSLEPPPASTSPTPDRLRSSNRAAMFPAPSR

SEQ ID NO: 242 - protein, 297 aa, Aspergillus niger
MFSGRFGVLLTALAALGAAAPAPLDVRSVSTSTLDELQLFAQWSAAAYCSNNIDSDDSNLTCTANACPSVEEASTTMLLEFDLTNDFGGTAGFLAADNTNKRLVVAFRGSSTIENWVANLDFILEDNDDLCTGCKVHTGFWKAWESAADDLTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGTGASVTASDIEVIEGINSTAGNAGEATVSVLAHLWYFFAISECLL

SEQ ID NO: 243 - protein, 297 aa, Aspergillus niger
MFSGRFGVLLTALAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 244 - protein, 297 aa, Aspergillus niger
MFSGRFGVLLTAHAALSAAAPTPLDVRSVSTSTLDELQLFSQWSAAAYCSNNIDSDDSNVTCTADACPSVEEASTKMLLEFDLTNNFGGTAGFLAADNTNKRLVVAFRGSSTIKNWIADLDFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 245 - protein, 297 aa, Aspergillus niger
MFSGRFGVLLTALAALSAAAPTPLDVRSVSTSTLDELQLFAQWSAAAYCSNNIDSDDSNVTCTADACPSVEEASTKMLLEFDLTNNFGGTAGFLAADNTNKRLVVAFRGSSTIKNWIADLGFILQDNDDLCTGCKVHTGFWKAWEAAADNLTSKIKSAMSTYSGYTLYFTGHSLGGALATLGATVLRNDGYSVELYTYGCPRVGNYALAEHITSQGSGANFRVTHLNDIVPRLPPMDFGFSQPSPEYWITSGTGASVTASDIELIEGINSTAGNAGEATVDVLAHLWYFFAISECLL

SEQ ID NO: 246 - protein, 334 aa, Yarrowia lipolytica
MKLSTILFTACATLAAALPSPITPSEAAVLQKRVYTSTETSHIDQESYNFFEKYARLANIGYCVGPGTKIFKPFNCGLQCAHFPNVELIEEFHDPRLIFDVSGYLAVDHASKQIYLVIRGTHSLEDVITDIRIMQAPLTNFDLAANISSTATCDDCLVHNGFIQSYNNTYNQIGPKLDSVIEQYPDYQIAVTGHSLGGAAALLFGINLKVNGHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 247 - protein, 334 aa, Yarrowia lipolytica
MKLSTILFTACATLAAALPSPITPSEAAVLQKRVYTSTETSHIDQESYNFFEKYARLANIGYCVGPGTKIFKPFNCGLQCAHFPNVELIEEFHDPRLIFDVSGYLAVDHASKQIYLVIRGIHSLEDVISDIRIMQAPLTNFDLAANISSTATCDDCLVHNGFIQSYNNTYNQIGPKLDSVIEQYPDYQIAVTGHSLGGAAALLFGINLKVNGHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 248 - protein, 291 aa, Talaromyces thermophilus
MRSSLVLFFVSAWTALASPVRREVSQDLFDQFNLFAQYSAAAYCAKNNDAPAGANVTCRGSICPEVEKADATFLYSFEDSGVGDVTGFLALDNTNRLIVLSFRGSRSLENWIGNINLDLKGIDDICSGCKGHDGFTSSWRSVANTLTQQVQNAVREHPDYRVVFTGHSLGGALATVAGASLRGNGYDIDVFSYGAPRVGNRAFAEFLTAQTGGTLYRITHTNDIVPRLPPRELGYSHSSPEYWITSGTLVPVTKNDIVKVEGIDSTDGNNQPNTPDIAAHLWYFGLIGTCL

SEQ ID NO: 249 - protein, 320 aa, Saccharomyces cerevisiae
SAKSSFISTTTTDLTSINTSAYSTGSISTVETGNRTTSEVISHVVTTSTKLSPTATTSLTIAQTSIYSTDSNITVGTDIHTTSEVISDVETISRETASTVVAAPTSTTGWTGAMNTYISQFTSSSFATINSTPIISSSAVFETSDASIVNVHTENITNTAAVPSEEPTFVNATRNSLNSFCSSKQPSSPSSYTSSPLVSSLSVSKTLLSTSFTPSVPTSNTYIKTKNTGYFEHTALTTSSVGLNSFSETAVSSQGTKIDTFLVSSLIAYPSSASGSQLSGIQQNFTSTSLMISTYEGKASIFFSAELGSIIFLLLSYLLF

SEQ ID NO: 250 - protein, 87 aa, Saccharomyces cerevisiae
MQLLRCFSIFSVIASVLAQELTTICEQIPSPTLESTPYSLSTTTILANGKAMQGVFEYYKSVTFVSNCGSHPSTTSKGSPINTQYVF

SEQ ID NO: 251 - protein, 1100 aa, Saccharomyces cerevisiae
MTMPHRYMFLAVFTLLALTSVASGATEACLPAGQRKSGMNINFYQYSLKDSSTYSNAAYMAYGYASKTKLGSVGGQTDISIDYNIPCVSSSGTFPCPQEDSYGNWGCKGMGACSNSQGIAYWSTDLFGFYTTPTNVTLEMTGYFLPPQTGSYTFKFATVDDSAILSVGGATAFNCCAQQQPPITSTNFTIDGIKPWGGSLPPNIEGTVYMYAGYYYPMKVVYSNAVSWGTLPISVTLPDGTTVSDDFEGYVYSFDDDLSQSNCTVPDPSNYAVSTTTTTTEPWTGTFTSTSTEMTTVTGTNGVPTDETVIVIRTPTTASTIITTTEPWNSTFTSTSTELTTVTGTNGVRTDETIIVIRTPTTATTAITTTEPWNSTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTEITTVTGTNGLPTDETIIVIRTPTTATTAMTTPQPWNDTFTSTSTEMTTVTGTNGLPTDETIIVIRTPTTATTAITTTEPWNSTFTSTSTEMTTVTGTNGLPTDETIIVIRTPTTATTAITTTQPWNDTFTSTSTEMTTVTGTNGLPTDETIIVIRTPTTATTAMTTTQPWNDTFTSTSTEITTVTGTTGLPTDETIIVIRTPTTATTAMTTTQPWNDTFTSTSTEMTTVTGTNGVPTDETVIVIRTPTSEGLISTTTEPWTGTFTSTSTEMTTVTGTNGQPTDETVIVIRTPTSEGLVTTTTEPWTGTFTSTSTEMTTITGTNGVPTDETVIVIRTPTSEGLISTTTEPWTGTFTSTSTEMTTITGTNGQPTDETVIVIRTPTSEGLISTTTEPWTGTFTSTSTEMTHVTGTNGVPTDETVIVIRTPTSEGLISTTTEPWTGTFTSTSTEVTTITGTNGQPTDETVIVIRTPTSEGLISTTTEPWTGTFTSTSTEMTTVTGTNGQPTDETVIVIRTPTSEGLVTTTTEPWTGTFTSTSTEMSTVTGTNGLPTDETVIVVKTPTTAISSSLSSSSSGQITSSI

SEQ ID NO: 252 - protein, 92 aa, Saccharomyces cerevisiae
MQFSTVASVAFVALANFVAAESAAAISQITDGQIQATTTATTEATTTAAPSSTVETVSPSSTETISQQTENGAAKAAVGMGAGALAAAAMLL

SEQ ID NO: 253 - protein, 337 aa, Saccharomyces cerevisiae
KLSTVLLSAGLASTTLAQFSNSTSASSTDVTSSSSISTSSGSVTITSSEAPESDNGTSTAAPTETSTEAPTTAIPTNGTSTEAPTTAIPTNGTSTEAPTDTTTEAPTTALPTNGTSTEAPTDTTTEAPTTGLPTNGTTSAFPPTTSLPPSNTTTTPPYNPSTDYTTDYTVVTEYTTYCPEPTTFTTNGKTYTVTEPTTLTITDCPCTIEKPTTTSTTEYTVVTEYTTYCPEPTTFTTNGKTYTVTEPTTLTITDCPCTIEKSEAPESSVPVTESKGTTTKETGVTTKQTTANPSLTVSTVVPVSSSASSHSVVINSNGANVVVPGALGLAGVAMLFL

SEQ ID NO: 254 - protein, 725 aa, Saccharomyces cerevisiae
MTLSFAHFTYLFTILLGLTNIALASDPETILVTITKTNDANGVVTTTVSPALVSTSTIVQAGTTTLYTTWCPLTVSTSSAAEISPSISYATTLSRFSTLTLSTEVCSHEACPSSSTLPTTTLSVTSKFTSYICPTCHTTAISSLSEVGTTTVVSSSAIEPSSASIISPVTSTLSSTTSSNPTTTSLSSTSTSPSSTSTSPSSTSTSSSSTSTSSSSTSTSSSSTSTSPSSTSTSSSLTSTSSSSTSTSQSSTSTSSSSTSTSPSSTSTSSSSTSTSPSSKSTSASSTSTSSYSTSTSPSLTSSSPTLASTSPSSTSISSTFTDSTSSLGSSIASSSTSVSLYSPSTPVYSVPSTSSNVATPSMTSSTVETTVSSQSSSEYITKSSISTTIPSFSMSTYFTTVSGVTTMYTTWCPYSSESETSTLTSMHETVTTDATVCTHESCMPSQTTSLITSSIKMSTKNVATSVSTSTVESSYACSTCAETSHSYSSVQTASSSSVTQQTTSTKSWVSSMTTSDEDFNKHATGKYHVTSSGTSTISTSVSEATSTSSIDSESQEQSSHLLSTSVLSSSSLSATLSSDSTILLFSSVSSLSVEQSPVTTLQISSTSEILQPTSSTAIATISASTSSLSATSISTPSTSVESTIESSSLTPTVSSIFLSSSSAPSSLQTSVTTTEVSTTSISIQYQTSSMVTISQYMGSGSQTRLPLGKLVFAIMAVACNVIFS

SEQ ID NO: 255 - DNA, 894 bp, Aspergillus tubingensis
atgttctctggacggtttggagtgcttttgacagcgcttgctgcgctgggtgctgccgcgccggcaccgcttgctgtgcggagtgtctcgacttccacgttggatgagttgcaattgttcgcgcaatggtctgccgcagcttattgctcgaataatatcgactcgaaagactccaacttgacatgcacggccaacgcctgtccatcagtcgaggaggccagtaccacgatgctgctggagttcgacctgacgaacgactttggaggcacagccggtttcctggccgcggacaacaccaacaagcggctcgtggtcgccttccggggaagcagcacgattgagaactggattgctaatcttgacttcatcctggaagataacgacgacctctgcaccggctgcaaggtccatactggtttctggaaggcatgggagtccgctgccgacgaactgacgagcaagatcaagtctgcgatgagcacgtattcgggctataccctatacttcaccgggcacagtttgggcggcgcattggctacgctgggagcgacagttctgcgaaatgacggatatagcgttgagctgtacacctatggatgtcctcgaatcggaaactatgcgctggctgagcatatcaccagtcagggatctggggccaacttccgtgttacacacttgaacgacatcgtcccccgggtgccacccatggactttggattcagtcagccaagtccggaatactggatcaccagtggcaatggagccagtgtcacggcgtcggatatcgaagtcatcgagggaatcaattcaacggcgggaaatgcaggcgaagcaacggtgagcgttgtggctcacttgtggtacttttttgcgatttccgagtgcctgctataa

SEQ ID NO: 256 - protein, 297 aa, Aspergillus tubingensis
MFSGRFGVLLTALAALGAAAPAPLAVRSVSTSTLDELQLFAQWSAAAYCSNNIDSKDSNLTCTANACPSVEEASTTMLLEFDLTNDFGGTAGFLAADNTNKRLVVAFRGSSTIENWIANLDFILEDNDDLCTGCKVHTGFWKAWESAADELTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGNGASVTASDIEVIEGINSTAGNAGEATVSVVAHLWYFFAISECLL

SEQ ID NO: 257 - DNA, 894 bp, Artificial sequence
  Coding sequence for Aspergillus tubinensis lip3, codon-optimized for expression in S. cerevisiae
atgttttcaggtagattcggcgttctactgacagcattagctgcattgggtgctgcagcgcctgccccattagcagtgcgttctgttagcacttccacccttgatgaactacaactctttgcccaatggtctgctgcagcctactgttcaaacaatattgattcaaaagacagtaacttaacatgcacagccaatgcttgtccttctgttgaggaggcttccacgacaatgctattagagttcgatctgaccaatgatttcggtggtactgccgggtttttagcagccgataataccaataagagattagtggtcgcgtttagaggatcatcaactattgagaactggatagctaaccttgatttcatccttgaagataatgatgacttgtgtactggctgcaaagtgcacacaggtttttggaaagcctgggaatcagctgctgacgaattgacatctaagatcaagtcagcaatgtctacttactctggttacacattgtacttcacgggtcattccttgggaggtgctttggccacactgggtgcgactgtcttgagaaatgacgggtatagtgtagaattatacacctacggatgcccaaggataggaaactatgcactagctgaacatattacttctcaaggcagtggtgcaaactttagagtcactcacttgaatgacattgttcctagagtcccaccaatggattttggttttagtcagccatctccagaatattggataacatctggaaacggagcttcagttactgcaagcgatattgaagtaatcgaaggcatcaattctacagctgggaatgctggcgaagcaacagtatccgttgttgctcatctctggtactttttcgcgatctctgaatgtttgctttaa

SEQ ID NO: 258 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 259 - protein, 347 aa, Beijerinkia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 260 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 261 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 262 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 263 - protein, 570 aa, Lactococcus lactis
MEFKYNGKVESVELNKYSKTLTPRSTQPATQAMYYGIGFKDEDFKKAQVGIVSMDWDGNPCNMHLGTLGSKIKSSVNQTDGLIGLQFHTIGVSDGIANGKLGMRYSLVSREVIADSIETNAGAEYYDAIVAIPGCDKNMPGSIIGMARLNRPSIMVYGGTIEHGEYKGEKLNIVSAFEALGQKITGNISDEDYHGVICNAIPGQGACGGMYTANTLAAAIETLGMSLPYSSSNPAVSQEKQEECDDIGLAIKNLLEKDIKPSDIMTKEAFENAITIVMVLGGSTNAVLHIIAMANAIGVEITQDDFQRISDIIPVLGDFKPSGKYMMEDLHKIGGLPAVLKYLLKEGKLHGDCLTVTGKTLAENVETALDLDFDSQDIMRPLKNPIKATGHLQILYGNLAQGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVSNEEIAKRRANYQKPTPKATRGVLAKFAKLTRPASEGCVTDL

SEQ ID NO: 264 - DNA, 41 bp, Artificial sequence
  Primer Ca_NA99_for
ctccaccattcatgcttgctgatactcaagtgaatactgag

SEQ ID NO: 265 - DNA, 41 bp, Artificial sequence
  Primer Ca_NA99_rev
ctcagtattcacttgagtatcagcaagcatgaatggtggag

SEQ ID NO: 266 - DNA, 44 bp, Artificial sequence
  Primer Cd_N146A_for
caactttgattttgcagcccgtatcagttcaacagccacttgtg

SEQ ID NO: 267 - DNA, 44 bp, Artificial sequence
  Primer Cd_N146A_rev
cacaagtggctgttgaactgatacgggctgcaaaatcaaagttg

SEQ ID NO: 268 - DNA, 43 bp, Artificial sequence
  Primer Cd_NA167_for
ggctttatcgaatcttacgccaatacattcaaccagattggtc

SEQ ID NO: 269 - DNA, 43 bp, Artificial sequence
  Primer Cd_NA167_rev
gaccaatctggttgaatgtattggcgtaagattcgataaagcc

SEQ ID NO: 270 - DNA, 7446 bp, Artificial sequence
  pTVAN26
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattagataccgcaaaccccttgtgttacaaagtattgcaagtgatttcctaagacattagcctgctgtagcagtgtatttcctgcactgcattgcttgtttctctgtccttcgcatgtaacaacattagacagtggaggatgtatcagtggccaatcgataaagacttcaccagaacaatgttgataaccatcccaaaaaggtatttgaggcacaatgtcccctctatgtgtgatcctgtatagttttctatcttttgttaccttggatacatcaggattctcttccccgaaaaacaacctatcgacccaattagcgaatccagcatttcccactataggttggcctagggtgacaactagtggatcatgaccgtttactttcaagttgattccgaacaatagggctgcagcaccacccagtgaatgaccggtaactgcaatttcgtaatctgggtgctctgctatcacagaatctaactttggaccaatctggttgaatgtattggcgtaagattcgataaagcctttatggactaaacagtcatcacaagtggctgttgaactgatattggctgcaaaatcaaagttggtcaatggagcctgaaggatacgaatgtcagtgattacatcttctaatgagtgggtacctcttatgacaaggtagatttgtttggatgtatgatcaactgcaagataaccggaaacgtcaaatacaagtcttgggtcgtggaactcttgaatcaattccacatttggaaaatgggcacattgtaagccacaattgaaaggtttgaaaatcttagtgcctgggccaacacaataaccgatgttggccaatcttgcgtatttctcgaaaaagttgtaagagtcttggttaatgtgtgaagtttcagtagatgtatacactctcttttgtaaagcagcagcttctgatggtgtaacaggtgaaggcaaagcggccaccaaagtagcgcaggcagtcaacagaattgtagatagcttcatcctcagctgaaacttagattagattgctatgctttctttctaatgagcaagaagtaaaaaaagttgtaatagagcaagaaaaatgaaactgaaacttgagaaattgaagaccgtttattaacttaaatatcaatgggaggtcatcgaaagagaaaaaaatcaaaaaaaaaattttcaagaaaaagaaacgtgataaaaatttttattgcctttttcggcgaagaaaaagaaacgaggcggtctcttttttttttccaaacctttagtacgggtagttaacgacaccctagaggaagaaagaggggaaatttagtatgctgtgcttgggtgttttgaagtggtacggcgatgcgcggagtccgagaaaatctggaagagtaaaaaaggagtagaaacattctgaagctatccgc

SEQ ID NO: 271 - DNA, 894 bp, Artificial sequence
  Coding sequence for Aspergillus tubingensis lip3 variant N59A, codon-optimized for expression in S. cerevisiae
atgttttcaggtagattcggcgttctactgacagcattagctgcattgggtgctgcagcgcctgccccattagcagtgcgttctgttagcacttccacccttgatgaactacaactctttgcccaatggtctgctgcagcctactgttcaaacaatattgattcaaaagacagtgctttaacatgcacagccaatgcttgtccttctgttgaggaggcttccacgacaatgctattagagttcgatctgaccaatgatttcggtggtactgccgggtttttagcagccgataataccaataagagattagtggtcgcgtttagaggatcatcaactattgagaactggatagctaaccttgatttcatccttgaagataatgatgacttgtgtactggctgcaaagtgcacacaggtttttggaaagcctgggaatcagctgctgacgaattgacatctaagatcaagtcagcaatgtctacttactctggttacacattgtacttcacgggtcattccttgggaggtgctttggccacactgggtgcgactgtcttgagaaatgacgggtatagtgtagaattatacacctacggatgcccaaggataggaaactatgcactagctgaacatattacttctcaaggcagtggtgcaaactttagagtcactcacttgaatgacattgttcctagagtcccaccaatggattttggttttagtcagccatctccagaatattggataacatctggaaacggagcttcagttactgcaagcgatattgaagtaatcgaaggcatcaattctacagctgggaatgctggcgaagcaacagtatccgttgttgctcatctctggtactttttcgcgatctctgaatgtttgctttaa

SEQ ID NO: 272 - protein, 297 aa, Artificial sequence
  Aspergillus tubingensis variant N59A
MFSGRFGVLLTALAALGAAAPAPLAVRSVSTSTLDELQLFAQWSAAAYCSNNIDSKDSALTCTANACPSVEEASTTMLLEFDLTNDFGGTAGFLAADNTNKRLVVAFRGSSTIENWIANLDFILEDNDDLCTGCKVHTGFWKAWESAADELTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGNGASVTASDIEVIEGINSTAGNAGEATVSVVAHLWYFFAISECLL

SEQ ID NO: 273 - DNA, 894 bp, Artificial sequence
  Coding sequence for Aspergillus tubingensis lip3 variant N269A, codon-optimized for expression in S. cerevisiae
atgttttcaggtagattcggcgttctactgacagcattagctgcattgggtgctgcagcgcctgccccattagcagtgcgttctgttagcacttccacccttgatgaactacaactctttgcccaatggtctgctgcagcctactgttcaaacaatattgattcaaaagacagtaacttaacatgcacagccaatgcttgtccttctgttgaggaggcttccacgacaatgctattagagttcgatctgaccaatgatttcggtggtactgccgggtttttagcagccgataataccaataagagattagtggtcgcgtttagaggatcatcaactattgagaactggatagctaaccttgatttcatccttgaagataatgatgacttgtgtactggctgcaaagtgcacacaggtttttggaaagcctgggaatcagctgctgacgaattgacatctaagatcaagtcagcaatgtctacttactctggttacacattgtacttcacgggtcattccttgggaggtgctttggccacactgggtgcgactgtcttgagaaatgacgggtatagtgtagaattatacacctacggatgcccaaggataggaaactatgcactagctgaacatattacttctcaaggcagtggtgcaaactttagagtcactcacttgaatgacattgttcctagagtcccaccaatggattttggttttagtcagccatctccagaatattggataacatctggaaacggagcttcagttactgcaagcgatattgaagtaatcgaaggcatcgcttctacagctgggaatgctggcgaagcaacagtatccgttgttgctcatctctggtactttttcgcgatctctgaatgtttgctttaa

SEQ ID NO: 274 - protein, 297 aa, Artificial sequence
  Aspergillus tubingensis variant N269A
MFSGRFGVLLTALAALGAAAPAPLAVRSVSTSTLDELQLFAQWSAAAYCSNNIDSKDSNLTCTANACPSVEEASTTMLLEFDLTNDFGGTAGFLAADNTNKRLVVAFRGSSTIENWIANLDFILEDNDDLCTGCKVHTGFWKAWESAADELTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGNGASVTASDIEVIEGIASTAGNAGEATVSVVAHLWYFFAISECLL

SEQ ID NO: 275 - DNA, 894 bp, Artificial sequence
  Coding sequence for Aspergillus tubingensis lip3 variant N59A/N269A, codon-optimized for expression in S. cerevisiae
atgttttcaggtagattcggcgttctactgacagcattagctgcattgggtgctgcagcgcctgccccattagcagtgcgttctgttagcacttccacccttgatgaactacaactctttgcccaatggtctgctgcagcctactgttcaaacaatattgattcaaaagacagtgctttaacatgcacagccaatgcttgtccttctgttgaggaggcttccacgacaatgctattagagttcgatctgaccaatgatttcggtggtactgccgggtttttagcagccgataataccaataagagattagtggtcgcgtttagaggatcatcaactattgagaactggatagctaaccttgatttcatccttgaagataatgatgacttgtgtactggctgcaaagtgcacacaggtttttggaaagcctgggaatcagctgctgacgaattgacatctaagatcaagtcagcaatgtctacttactctggttacacattgtacttcacgggtcattccttgggaggtgctttggccacactgggtgcgactgtcttgagaaatgacgggtatagtgtagaattatacacctacggatgcccaaggataggaaactatgcactagctgaacatattacttctcaaggcagtggtgcaaactttagagtcactcacttgaatgacattgttcctagagtcccaccaatggattttggttttagtcagccatctccagaatattggataacatctggaaacggagcttcagttactgcaagcgatattgaagtaatcgaaggcatcgcttctacagctgggaatgctggcgaagcaacagtatccgttgttgctcatctctggtactttttcgcgatctctgaatgtttgctttaa

SEQ ID NO: 276 - protein, 297 aa, Artificial sequence
  Aspergillus tubingensis variant N59A/N269A
MFSGRFGVLLTALAALGAAAPAPLAVRSVSTSTLDELQLFAQWSAAAYCSNNIDSKDSALTCTANACPSVEEASTTMLLEFDLTNDFGGTAGFLAADNTNKRLVVAFRGSSTIENWIANLDFILEDNDDLCTGCKVHTGFWKAWESAADELTSKIKSAMSTYSGYTLYFTGHSLGGALATLGATVLRNDGYSVELYTYGCPRIGNYALAEHITSQGSGANFRVTHLNDIVPRVPPMDFGFSQPSPEYWITSGNGASVTASDIEVIEGIASTAGNAGEATVSVVAHLWYFFAISECLL

SEQ ID NO: 277 - skipped

SEQ ID NO: 278 - DNA, 7471 bp, Artificial sequence
  pTVAN7
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccggggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaattatggtgtaactataccactacatgtacgtttacccacagcaaaaggcctagcgtatggcataaggtctggttcgcagttttgttttggacctgcaacaattgcagcagcagctggtgctaaaagagctgcagcggctactttctgttcaggtgtcaaatcgttggctggaagtggattacagtcggttatgccgtagtctgctgatctagcctgccctgtagtagatcttaaggcagatctacccaccacataagagaattgagaagtcaaggacccagcatgatcgatgacaaacaatggaccgcaaacagcttgggcctgtacgtttttgccgttaaacaggtatgaagagtctagtggtgaattagatacctgaggttgaacgatttcatctgtggcagaatacaagttagttgtaggcacgatttgtgttaacccaccggcatttctcaaagcggttgtcaatgcagaaccagttgtttgttgccaaacactaggggctgaaactgccagggcatcaagagggcctgctagaacggttcccttgtaatctggtgcgaaagccatcagtctatccactttagatcttatactagggaaaaaggttagtccccattgtgcaaccaagccgccttgggaccaagttaagactggcaacttattgtttccggatccagcgtatagggcagtaattgcattaaccatgtactcagtattcacttgagtatcattaagcatgaatggtggaggtgaaatccaacatggagtatagcctaattgagtggataatgggatccaattagagtcgaatgattgtggtccggttgtaccagtaccaggtaccaataagataggctttgagacactagatggtgaggcaccttggcatgttaaacctgcatccaagactgactttggttgagaaaaggcagggtcactaccggatggtagtcttttgactagtggtgttgcggcgacacaagtagccagtacgccagctacacctgtcaaggaaagtagcttcatcctcagctgaaacttggattagattgctatgctcccgttctactgagtgagaagtaagaagggtcgtaataggacgggagaaaggaaactgaaacttgagaggttgaagaccgttcattaacctaaataccaacgggaggccgtcgaaagagaacaagatcgaagaaaaggttctcaaggaaaggagacatgataaaaacttctattgcccccttcgacgaagaaaagaagacgaggcggtctctttctccttccccaaacccttagtacgagtaactagtgacaccctagaggaagaaagaggggagatttggtatgctgcgcttgggggctttgaggtggtacggcgatgcgcggagtctgagaaaacctggaggagtaaagggggagccgaagcactttagagccgtccgc

What is claimed is:

1. A method comprising:
(a) providing a fermentation medium comprising fermentable carbon substrate derived from a biomass feedstock and an alcohol-producing yeast microorganism wherein the alcohol-producing microorganism comprises an engineered polynucleotide encoding a polypeptide having lipase activity and the microorganism expresses and displays or secretes said polypeptide such that the lipase activity is present in the fermentation medium, wherein the alcohol-producing microorganism further comprises reduced or eliminated pyruvate decarboxylase activity, and wherein the microorganism ferments the fermentable carbon substrate to produce alcohol, wherein the alcohol is a $C_3$ to $C_8$ alkyl alcohol; and
(b) contacting the fermentation medium with a carboxylic acid wherein the lipase activity is present in the fermentation medium in sufficient amount to convert at least a portion of the alcohol produced by the microorganism to alcohol esters extracellularly.

2. The method of claim 1 further comprising contacting the fermentation medium with an extractant to form a two-phase mixture comprising an aqueous phase and an organic phase.

3. The method of claim 2 wherein the extractant comprises the carboxylic acid.

4. The method of claim 1 wherein the alcohol is butanol.

5. The method of claim 4 wherein the alcohol esters comprise fatty acid butyl esters.

6. The method of claim 5 wherein the polypeptide having lipase activity comprises a sequence having at least 70% identity to any one of SEQ ID NOs: 249, 250, 251, 252, 253 or a fragment thereof having lipase activity.

7. The method of claim 1 wherein the polynucleotide encoding a polypeptide having lipase activity comprises a sequence with at least 95% identity to a polynucleotide having SEQ ID NO: 1, 3, 5, 7, 8, 9, 46, 48, 50, 52, 54, 255, 271 or 273.

8. The method of claim 1 wherein the polypeptide having lipase activity comprises a sequence with at least 70% identity to a polypeptide having SEQ ID NO: 2, 4, 6, 256, 47, 49, 51, 53, 55, 241, 242, 243, 244, 245, 246, 247, 248, 272, or 274 or a fragment thereof having lipase activity.

9. The method of claim 8 wherein the polypeptide having lipase activity does not contain a glycosylation motif.

10. The method of claim 1 wherein the polypeptide having lipase activity is not glycosylated.

11. The method of claim 1 wherein the carboxylic acid comprises free fatty acids derived from corn oil, canola oil, palm oil, linseed oil, jatropha oil, or soybean oil.

12. The method of claim 1 wherein the carboxylic acid is derived from the same biomass feedstock as the fermentable carbon substrate.

13. The method of claim 1 wherein the carboxylic acid comprises carboxylic acids having $C_{12}$ to $C_{22}$ linear or branched aliphatic chains.

14. The method of claim 3 wherein the contacting with extractant and the contacting with carboxylic acid occur contemporaneously.

15. The method of claim 1 wherein at least about 60% of the effective titer of alcohol produced by the microorganism is converted to alcohol esters.

16. The method of claim 1 wherein the fermentation medium further comprises triglycerides, diglycerides, monoglycerides, and phospholipids, or combinations thereof and wherein the lipase activity hydrolyzes at least a portion of the triglycerides, diglycerides, monoglycerides, and phospholipids, or combinations thereof to form free fatty acids.

17. The method of claim 1 wherein the effective titer or the effective rate of alcohol produced during a fermentation is greater than that produced during a fermentation by an alcohol-producing microorganism that does not comprise a polynucleotide encoding a polypeptide having lipase activity and the microorganism expresses and secretes or displays said polypeptide such that the lipase activity is present in the fermentation medium.

18. A method of increasing tolerance of an alcohol-producing microorganism to the produced alcohol, the method comprising:
  a. engineering a microorganism to express and secrete or display a polypeptide having lipase activity, wherein the microorganism further comprises reduced or eliminated pyruvate decarboxylase activity;
  b. contacting the engineered microorganism with
    i. triglycerides, diglycerides, monoglycerides, phospholipids, free fatty acids, or a mixture thereof, wherein the secreted or displayed lipase converts at least a portion of the triglycerides, diglycerides, monoglycerides, phospholipids, or mixtures thereof into free fatty acids; and
    ii. a fermentable carbon substrate, wherein the carbon substrate is selected from monosaccharides, disaccharides, oligosaccharides, polysaccharides, one carbon substrates, or mixtures thereof;
under conditions whereby the microorganism produces an alcohol, whereby the lipase activity is present in sufficient amount to convert at least a portion of the alcohol produced by the microorganism to alcohol esters, and wherein the tolerance of the microorganism to the product alcohol is increased.

19. The method of claim 18 wherein the microorganism produces alcohol at an effective titer greater than that produced by a microorganism that has not been engineered to express and secrete a polypeptide with lipase activity.

20. The method of claim 18 wherein the microorganism comprises an engineered alcohol biosynthetic pathway.

21. The method of claim 20 wherein the engineered alcohol biosynthetic pathway is an isobutanol biosynthetic pathway.

22. A method of producing butyl esters during a fermentation comprising
  (a) providing a fermentation medium comprising a carbon substrate and triglycerides, diglycerides, monoglycerides, and phospholipids, or a mixture thereof, wherein the carbon substrate is selected from monosaccharides, disaccharides, oligosaccharides, polysaccharides, one carbon substrates, or mixtures thereof; and
  (b) contacting the fermentation medium with an alcohol-producing microorganism comprising a butanol biosynthetic pathway wherein said microorganism further comprises an engineered polynucleotide encoding a polypeptide having lipase activity and which expresses and secretes or displays the polypeptide such that the lipase activity is present in the fermentation medium, and wherein said microorganism further comprises reduced or eliminated pyruvate decarboxylase activity, under conditions whereby the microorganism produces butanol, whereby the lipase activity is present in sufficient amount to convert at least a portion of the butanol produced by the microorganism to butyl esters.

23. The method of claim 22 wherein the fermentation medium further comprises one or more carboxylic acids.

24. The method of claim 22 wherein the carbon substrate is derived from biomass.

\* \* \* \* \*